United States Patent
Munger et al.

(10) Patent No.: US 7,321,830 B2
(45) Date of Patent: Jan. 22, 2008

(54) IDENTIFYING DRUGS FOR AND DIAGNOSIS OF BENIGN PROSTATIC HYPERPLASIA USING GENE EXPRESSION PROFILES

(75) Inventors: William E. Munger, Gaithersburg, MD (US); Prakash Kulkarni, Gaithersburg, MD (US); Robert H. Getzenberg, Pittsburgh, PA (US); Iwao Waga, Yokohama (JP); Jun Yamamoto, Yokohama (JP)

(73) Assignees: Gene Logic, Inc., Gaithersburg, MD (US); University of Pittsburgh, Pittsburgh, PA (US)

( * ) Notice: Subject to any disclaimer, the term of this patent is extended or adjusted under 35 U.S.C. 154(b) by 0 days.

(21) Appl. No.: 09/960,706

(22) Filed: Sep. 24, 2001

(65) Prior Publication Data

US 2003/0134280 A1  Jul. 17, 2003

Related U.S. Application Data

(63) Continuation-in-part of application No. 09/873,319, filed on Jun. 5, 2001, now abandoned.

(60) Provisional application No. 60/223,323, filed on Aug. 7, 2000.

(51) Int. Cl.
*G06F 19/00* (2006.01)
*G01N 33/50* (2006.01)
*C12Q 1/68* (2006.01)
*C07H 21/04* (2006.01)

(52) U.S. Cl. .................. 702/19; 702/27; 536/23.1; 435/6

(58) Field of Classification Search ............ 700/90; 702/19; 707/1, 102
See application file for complete search history.

(56) References Cited

U.S. PATENT DOCUMENTS

| | | | |
|---|---|---|---|
| 5,763,429 A | 6/1998 | Bishop et al. | |
| 5,882,864 A | 3/1999 | An et al. | |
| 5,953,727 A * | 9/1999 | Maslyn et al. | ............ 707/104.1 |
| 2003/0134324 A1 | 7/2003 | Munger et al. | .............. 435/7.1 |

OTHER PUBLICATIONS

NCBI accession No. N30198. Jan. 5, 1996.*
NCBI accession No. R93908. Aug. 30, 1995.*
NCBI accession No. S77622. May 7, 1993.*
Hillier et al. Accession No. AA410383, May 17, 1997, record retrieved from www.ncbi.nlm.nih.gov.*
Elsasser-Beile et al., Comparison of the Activation Status of Tumor Infiltrating and Peripheral Lymphocytes of Patients with Adenocarcinomas and Benign Hyperplasia of the Prostate, (2000) The Prostate, 45:1-7.
Shidaifat et al., Gossypol Arrests Human Benign Prostatic Hyperplastic Cell Growth at G0/G1 Phase of the Cell Cycle, (1997) Anticancer Res. 17:1003-1010.
Bubendorf, L et al. Survey of gene amplifications during prostate cancer progression by high-throughput fluorescence in situ hybridization on tissue microarrays. (1999) Cancer Research 59:803-806.
Bubendorf, L et al. Hormone therapy failure in human prostate cancer: analysis by complementary DNA and tissue microarrays. (1999) J. Nat. Cancer Inst. 91(20):1758-1764.
Brinkman, U. et al. Page-1 an X Chromosome-Linked Gage-Like Gene That is Expressed in Normal and Neoplastic Prostate, Testis, and Uterus (1998) *Proc. Natl. Acad. Sci. (USA)* 96:20767-20762.
Brinkman, U. et al. Novel Genes in the Page and Gage Family of Tumor Antigens Found by Homology Walking in the dbEST Database. (1999) *Cancer Res. 59*, 1445-148.
Isomura, M. et al. Isolation and Mapping of RAB2L, a Human cDNA That Encodes a Protein Homologous to RalGDS. (1996) *Cyogenet.Cell Genet.* 74, 263-265.
Jacob, K. et al. Osteonectin Promotes Prostate Cancer Cell Migration and Invasion: a Possible Mechanism for Metastasis to Bone (1999) *Cancer Res.* 59:4453-4457.
Nollet, F. et al. Phylogenetic Analysis of the Cadherin Superfamily Allows Identifidation of Six Major Subfamilies Besides Several Solitary Members (2000) *J. Mol. Bio.* 299, 51-572.
Seto, M.H. et al. Pro Fold Analysis of the B30.2-Like Domain (1999) *Proteins* 35:235-49.
Thomas, R. et al. Differential Expresion of Osteonectin/SPARC During Human Prostate Cancer Progression (2000) *Clin. Cancer Res.* 6:1140-1149.

* cited by examiner

*Primary Examiner*—Marjorie A. Moran
(74) *Attorney, Agent, or Firm*—Morgan, Lewis & Bockius LLP

(57) ABSTRACT

The present invention relates to a computer system comprising a database for elucidating changes in gene expression in prostate tissue isolated from patients exhibiting different clinical states of prostate hyperplasia as compared to normal prostate tissue, as well as the identification of individual genes that are differentially expressed in diseased prostate tissue.

12 Claims, 9 Drawing Sheets

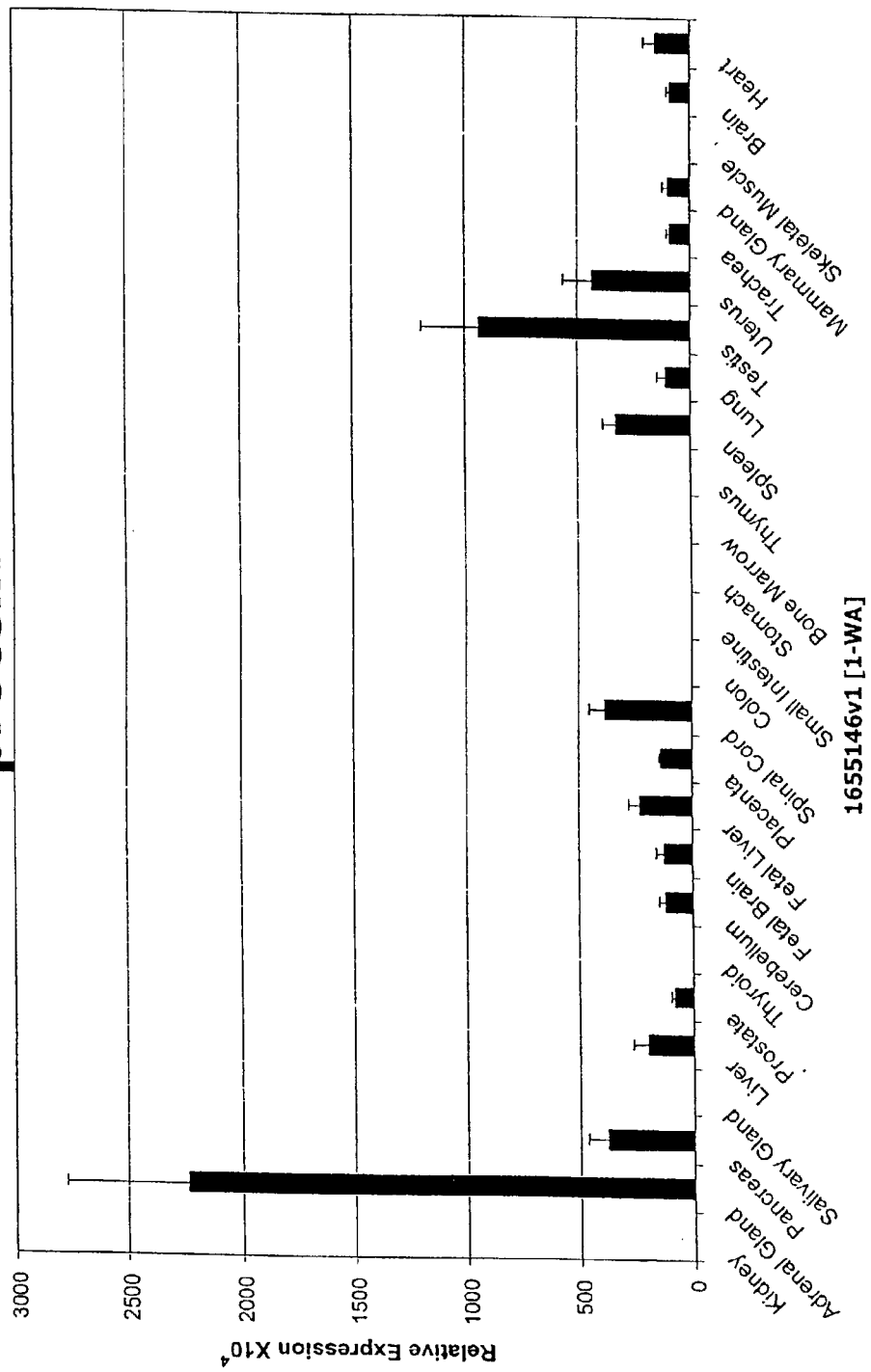
Figure 1: N91971, cellular retinol binding protein

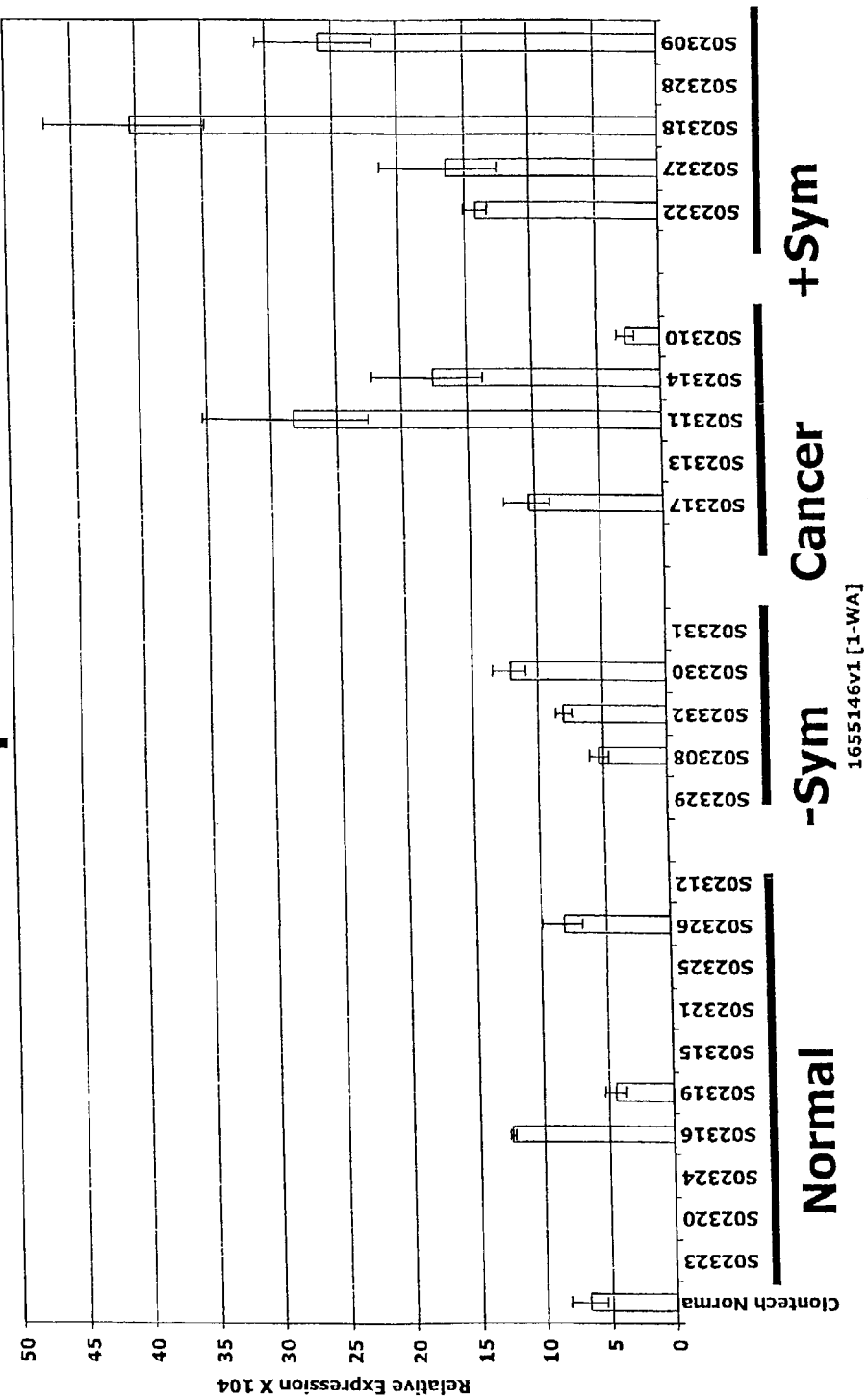

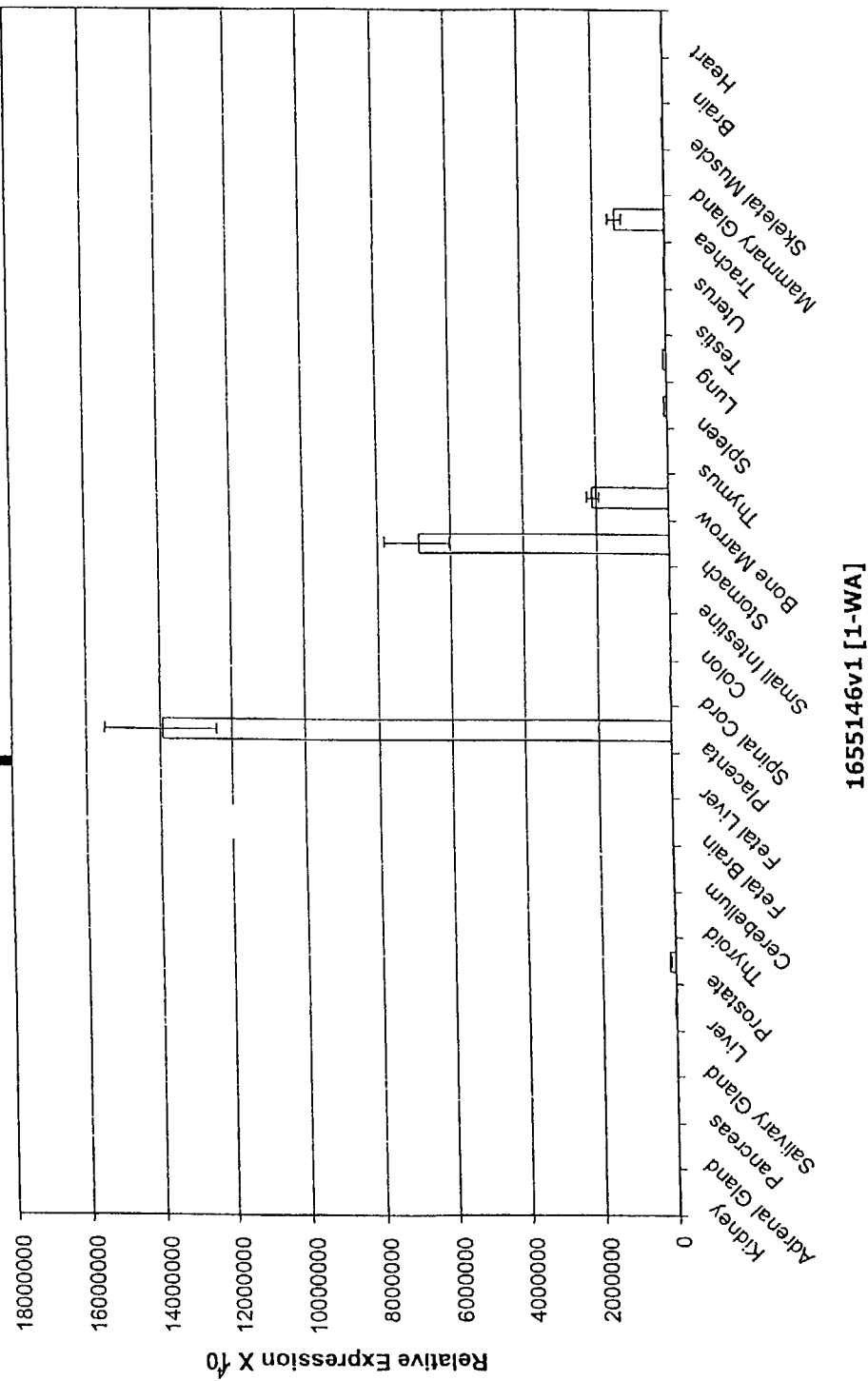

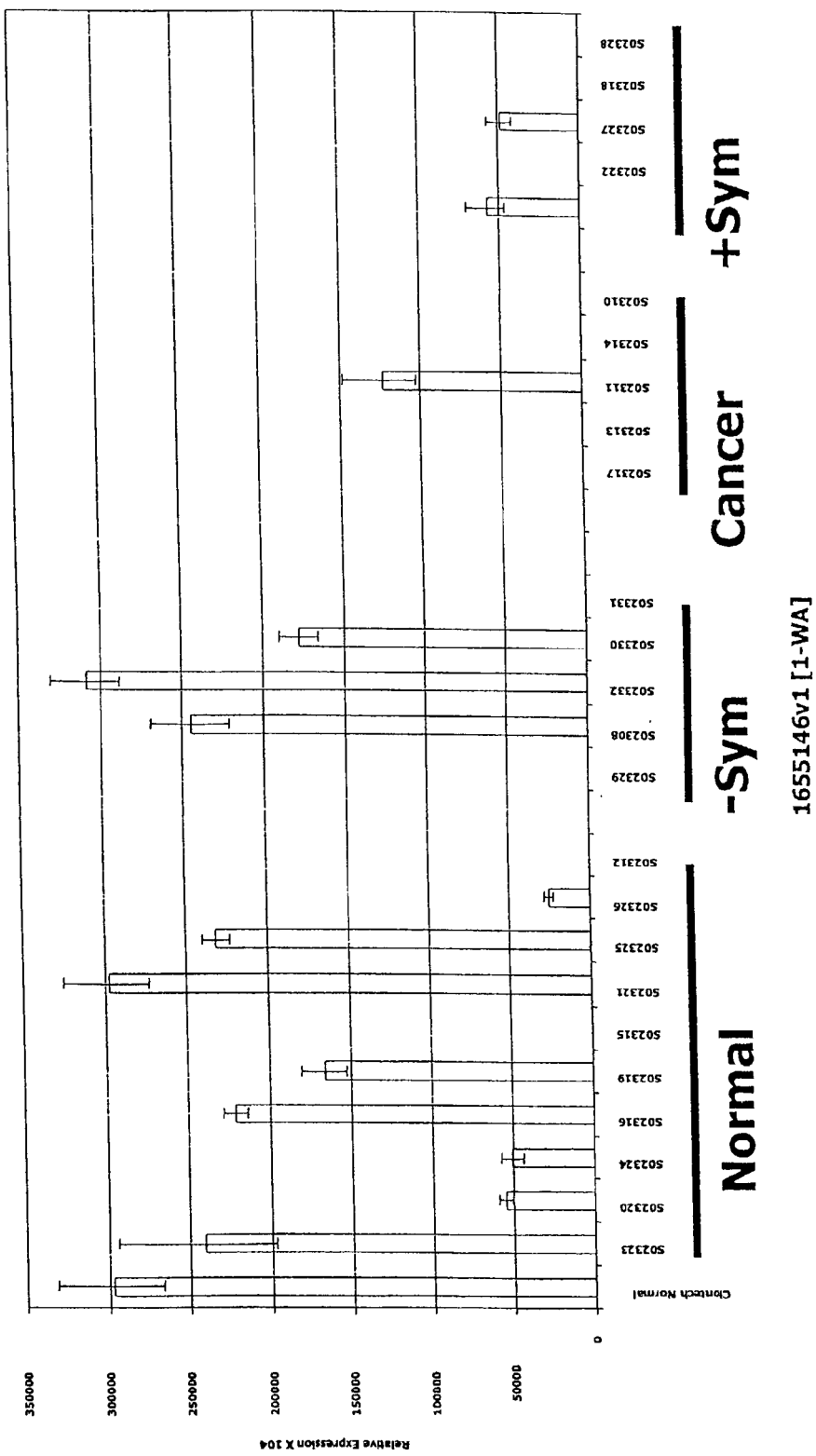
Figure 4: X65614, S100-calcium binding protein

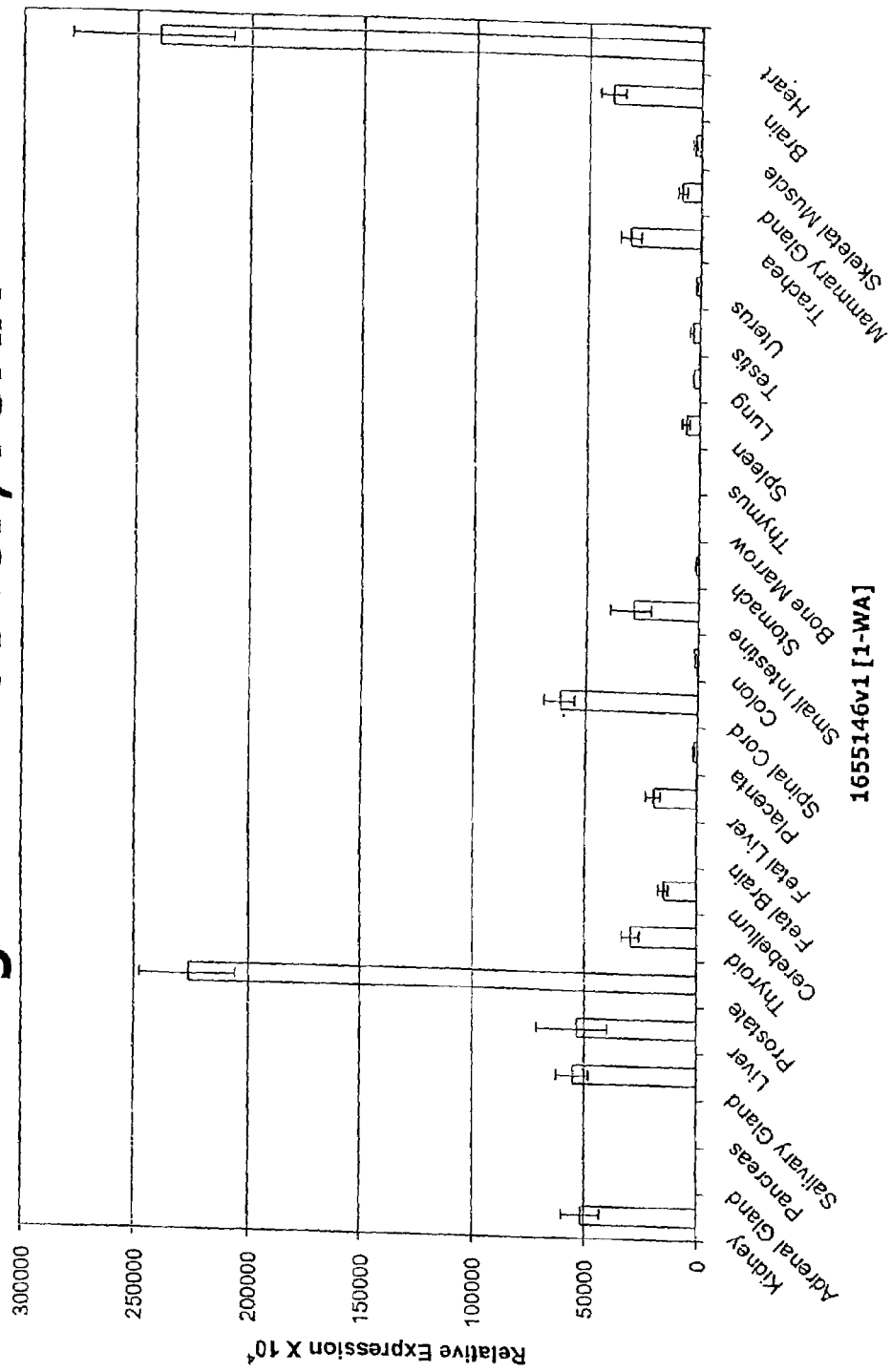

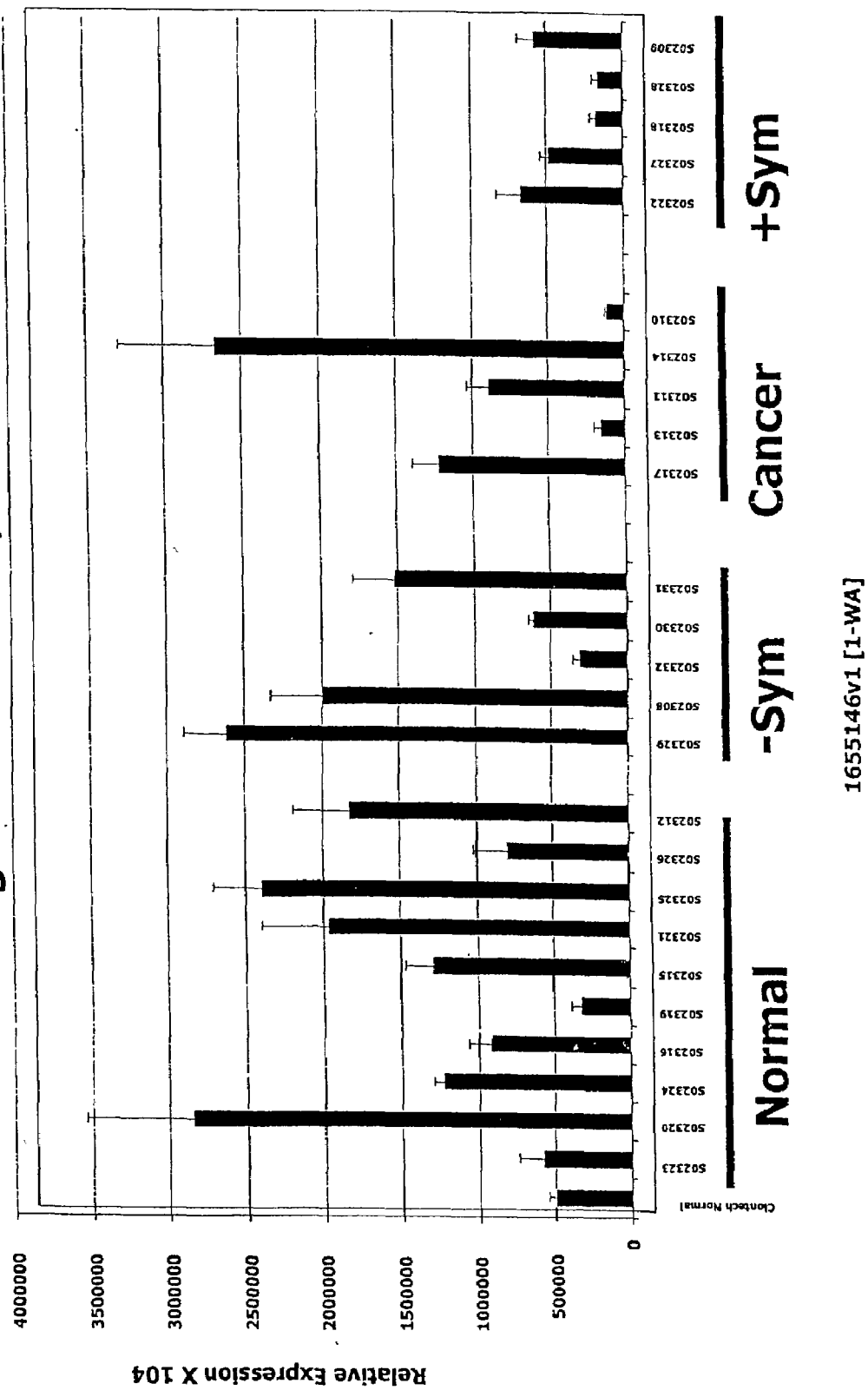
Figure 6: M99487, PSMA

IDENTIFYING DRUGS FOR AND DIAGNOSIS OF BENIGN PROSTATIC HYPERPLASIA USING GENE EXPRESSION PROFILES

RELATED APPLICATIONS

This application is a continuation-in-part of U.S. application Ser. No. 09/873,319, filed Jun. 5, 2001 now abandoned, which claims priority to U.S. Provisional Application No. 60/223,323, filed Aug. 7, 2000, both of which are herein incorporated by reference in their entirety.

BACKGROUND OF THE INVENTION

Benign Prostatic Hyperplasia (BPH) is the most common benign tumor in men aged >60 years. It is estimated that one in four men living to the age of 80 will require treatment for this disease. BPH is usually noted clinically after the age of 50, the incidence increasing with age, but as many as two thirds of men between the ages of 40 and 49 demonstrate histological evidence of the disease.

The anatomic location of the prostate at the bladder neck enveloping the urethra plays an important role in the pathology of BPH, including bladder outlet obstruction. Two prostate components are thought to play a role in bladder outlet obstruction. The first is the relative increased prostate tissue mass. The second component is the prostatic smooth muscle tone.

The causative factors of BPH in man have been intensively studied. See Ziada et al., *Urology*, 53: 1-6, 1999. In general, the two most important factors appear to be aging and the presence of functional testes. Although these factors appear to be key to the development of BPH, both appear to be nonspecific.

Little is known about the molecular changes in prostate cells associated with the development and progression of BPH. It has been demonstrated that the expression levels of a number of individual genes are changed compared to normal prostate cells. These changes in gene expression include decreased expression of Wilm's tumor gene (WT-1) and increased expression of insulin growth factor II (IGF-II) (Dong et al., *J. Clin. Endocrin. Metab.*, 82(7): 2198-220).

While the changes in the expression levels of a number of individual genes have been identified, the investigation of the global changes in gene expression has not been reported. Accordingly, there exists a need for the investigation of the changes in global gene expression levels as well as the need for the identification of new molecular markers associated with the development and progression of BPH. Furthermore, if intervention is expected to be successful in halting or slowing down BPH, means of accurately assessing the early manifestations of BPH need to be established. One way to accurately assess the early manifestations of BPH is to identify markers which are uniquely associated with disease progression. Likewise, the development of therapeutics to prevent or stop the progression of BPH relies on the identification of genes responsible for BPH growth and function.

SUMMARY OF THE INVENTION

The present invention is based on the elucidation of the global changes in gene expression in BPH tissue isolated from patients exhibiting different clinical states of prostate hyperplasia as compared to normal prostate tissue as well as the identification of individual genes that are differentially expressed in BPH tissue.

The invention is also based on the discovery of a means of effectively selecting disease-linked drug targets from gene expression results. The invention includes methods of classifying genes whose expression levels are changed in diseased tissues, during disease induction or during disease progression into specific groups. By using this method it is possible to classify genes whose expression are regulated by the same mechanism into the same group, and it is possible to identify representative marker genes by selecting typical genes from each cluster.

The invention includes methods of screening for or identifying an agent that modulates the onset or progression of BPH, comprising: preparing a first gene expression profile of BPH cells; exposing the cells to the agent; preparing a second gene expression profile of the agent exposed cells; and comparing the first and second gene expression profiles. In a preferred embodiment of these methods, the gene expression profile comprises the expression levels of one or more or preferably two or more genes in Tables 1-6. In another preferred embodiment of these methods, the cell is a prostate cell from a BPH patient, a cell line in Table 7, or a derivative thereof.

The invention also includes methods of monitoring a treatment of a patient with BPH, comprising administering a pharmaceutical composition to the patient; preparing a gene expression profile from a prostate cell or tissue sample from the patient; and comparing the patient gene expression profile to a gene expression profile from a normal prostate cell population, a BPH tissue or BPH cells without treatment with the pharmaceutical composition. In preferred embodiments of these methods, the gene expression profile comprises the expression levels of one or more or, preferably two or more genes in Tables 1-6.

The invention also includes methods of diagnosing benign prostatic hyperplasia (BPH) in a subject comprising the step of detecting the level of expression in a tissue or cell sample from the subject of two or more genes from Tables 1-6 (preferably Tables 3-5, and more preferably Table 5); wherein differential expression of the genes is indicative of BPH progression.

The invention further includes methods of detecting the onset or progression of benign prostatic hyperplasia (BPH) in a patient comprising the step of detecting the level of expression in a tissue or cell sample of two or more genes from Tables 1-6 (preferably Tables 3-5, and more preferably Table 5); wherein differential expression of the genes is indicative of BPH progression.

The invention also includes methods of differentiating benign prostatic hyperplasia (BPH) from prostate cancer in a patient comprising the step of detecting the level of expression in a tissue or cell sample of two or more genes from Tables 1-6 (preferably Tables 3-5, and more preferably Table 5); wherein differential expression of the genes is indicative of BPH rather than prostate cancer.

The invention also includes methods of selecting or identifying cells that can be used for drug screening.

All of these methods may include the step of detecting the expression levels of at least about 2, 3, 4, 5, 6, 7, 8, 9, 10 or more genes in any of Tables 1-6, or preferably Table 5. In a preferred embodiment, expression of all of the genes or nearly all of the genes in Tables 1-6, or preferably Table 5, may be detected.

The invention further includes sets of at least two or more probes, wherein each of the probes comprises a sequence that specifically hybridizes to a gene in Tables 1-6 as well as solid supports comprising at least two or more of the probes.

The invention also includes computer systems comprising or linked to a database containing information identifying the expression level in BPH tissue or cells of a set of genes comprising at least two genes in Tables 1-6, preferably Table 5; and a user interface to view the information. The database may further comprise sequence information for the genes as well as information identifying the expression level for the set of genes in normal prostate tissue or cells, and prostate cancer tissue. The database may further contain or be linked to descriptive information from an external database, which information correlates said genes to records in the external database.

The invention further includes methods of using the disclosed computer systems to present information identifying the expression level in a tissue or cell of a set of genes comprising at least one of the genes in Tables 1-6, preferably Table 5, comprising comparing the expression level of at least one gene in Tables 1-6, preferably Table 5, in the tissue or cell to the level of expression of the gene in the database.

Lastly, the invention includes kits comprising probes or solid supports of the invention. In some embodiments, the kits also contain written materials or software concerning gene expression information for the genes of the invention, preferably in electronic format.

BRIEF DESCRIPTION OF THE DRAWINGS

FIG. 1. FIG. 1 shows the expression of cellular retinol binding protein RNA in various tissues.

FIG. 2. FIG. 2 shows the expression of cellular retinol binding protein RNA in various prostate tissues samples. In all of the figures, "Normal", "−Sym", "Cancer" and "+Sym" refer to normal prostate, BPH without symptoms, prostate cancer, and BPH with symptoms, respectively.

FIG. 3. FIG. 3 shows the expression of S100 calcium binding protein RNA in various tissues.

FIG. 4. FIG. 4 shows the expression of S100 calcium binding protein RNA in various prostate tissue samples.

FIG. 5. FIG. 5 shows the expression of human prostate-specific membrane antigen (PSMA) RNA in various tissues.

FIG. 6. FIG. 6 shows the expression of PSMA RNA in various prostate tissue samples.

FIG. 7A shows a 3-dimensional view of the results of a Preferred Component Analysis (PCA) comparing BPH patients with symptoms (S), asymptomatic BPH patients (O), asymptomatic BPH patients with prostate cancer (C) and normal control subjects (N). FIG. 7B shows the same PCA in a 2-dimensional format plotting component 1 versus components 2+3. The patients are depicted here as: BPH patients with symptoms (BPHWS), asymptomatic BPH patients (BPHNoS), asymptomatic BPH patients with prostate cancer (Cancer) and normal control subjects (Normal). FIG. 7C depicts the same data as FIG. 7B, with the addition of two additional normal (Norm) and three additional BPH patients with symptoms (BPH).

DETAILED DESCRIPTION

Figure 7A:
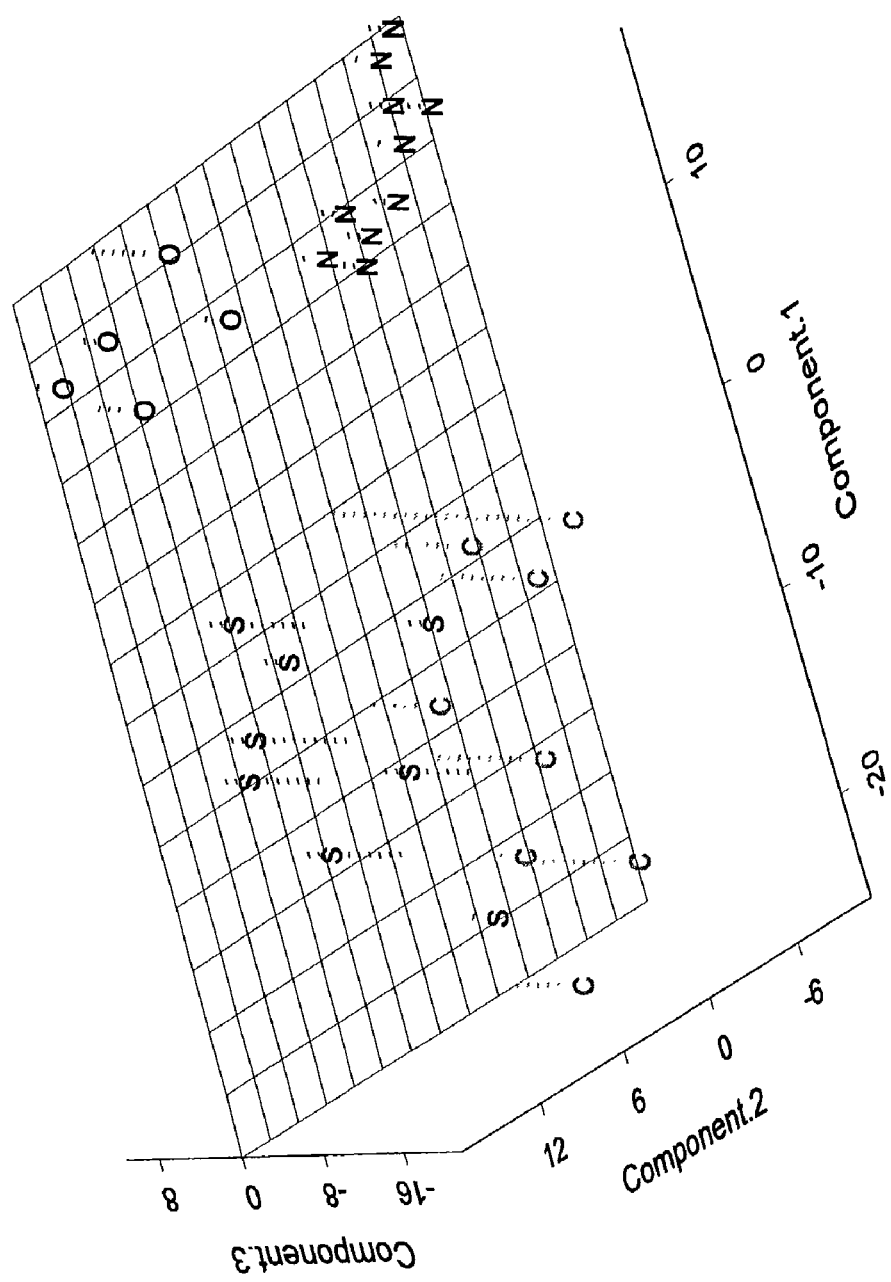
FIGS. 7A-7C.

Many biological functions are accomplished by altering the expression of various genes through transcriptional (e.g. through control of initiation, provision of RNA precursors, RNA processing, etc.) and/or translational control. For example, fundamental biological processes such as cell cycle, cell differentiation and cell death, are often characterized by the variations in the expression levels of groups of genes.

Changes in gene expression also are associated with pathogenesis. For example, the lack of sufficient expression of functional tumor suppressor genes and/or the over expression of oncogene/protooncogenes could lead to tumorgenesis or hyperplastic growth of cells (Marshall, Cell, 64: 313-326 (1991); Weinberg, Science, 254:1138-1146 (1991)). Thus, changes in the expression levels of particular genes (e.g. oncogenes or tumor suppressors) serve as signposts for the presence and progression of various diseases.

Monitoring changes in gene expression may also provide certain advantages during drug screening development. Often drugs are screened for the ability to interact with a major target without regard to other effects the drugs have on cells. Often such other effects cause toxicity in the whole animal, which prevent the development and use of the potential drug.

The present inventors have examined tissue from normal prostate, BPH and BPH prostate tissue immediately adjacent to malignant prostate tissue to identify the global changes in gene expression in BPH. These changes in gene expression, also referred to as expression profiles, provide useful markers for diagnostic uses as well as markers that can be used to monitor disease states, disease progression, toxicity, drug efficacy and drug metabolism.

Assay Formats

The genes identified as being differentially expressed in BPH tissue or BPH cells (Tables 1-6) may be used in a variety of nucleic acid detection assays to detect or quantititate the expression level of a gene or multiple genes in a given sample. For example, traditional Northern blotting, nuclease protection, RT-PCR and differential display methods may be used for detecting gene expression levels. Those methods are useful for some embodiments of the invention, particularly when smaller numbers of genes are assayed. For instance, when fewer than 50 genes are assayed, RT-PCR techniques can be used to prepare high-throughput assays. However, methods and assays of the invention are most efficiently designed with hybridization-based methods for detecting the expression of a large number of genes.

Any hybridization assay format may be used, including solution-based and solid support-based assay formats. Solid supports containing oligonucleotide probes for differentially expressed genes of the invention can be filters, polyvinyl chloride dishes, silicon or glass based beads or chips, etc. Such supports and hybridization methods are widely available, for example, those disclosed by Beattie (WO 95/11755). Any solid surface to which oligonucleotides can be bound, either directly or indirectly, either covalently or non-covalently, can be used.

A preferred solid support is a high density array or DNA chip. These contain a particular oligonucleotide probe in a predetermined location on the array. Each predetermined location may contain more than one molecule of the probe, but each molecule within the predetermined location has an identical sequence. Such predetermined locations are termed features. There may be, for example, from 2, 10, 100, 1000 to 10,000, 100,000 or 400,000 of such features on a single solid support. The solid support, or the area within which the probes are attached may be on the order of about a square centimeter.

Oligonucleotide probe arrays for expression monitoring can be made and used according to any technique known in the art (see for example, Lockhart et al., Nat. Biotechnol. (1996) 14, 1675-1680; McGall et al., *Proc. Nat. Acad. Sci. USA* (1996) 93, 13555-13460). Such probe arrays may contain at least two or more oligonucleotides that are complementary to or hybridize to two or more of the genes described in Tables 1-6. For instance, such arrays may contain oligonucleotides that are complementary or hybridize to at least about 2, 3, 4, 5, 6, 7, 8, 9, 10, 20, 30, 50, 70 or more of the genes described herein.

The genes which are assayed according to the present invention are typically in the form of mRNA or reverse transcribed mRNA. The genes may be cloned or not. The genes may be amplified or not. The cloning itself does not appear to bias the representation of genes within a population. However, it may be preferable to use polyA+ RNA as a source, as it can be used with less processing steps.

The sequences and related information of the genes described herein are available in the public databases. Tables 1-6 provide the Accession numbers and name for each of the sequences. Each Accession Number corresponds to a sequence in the attached sequence listing. The sequences and related information of the genes listed in the Tables according to their GenBank identifiers are expressly incorporated herein as of the filing date of this application, as are sequences in the databases related to those herein described, such as fragments, variant sequences, etc.

Probes based on the sequences of the genes described above may be prepared by any commonly available method. Oligonucleotide probes for interrogating the tissue or cell sample are preferably of sufficient length to specifically hybridize only to appropriate, complementary genes or transcripts. Typically the oligonucleotide probes will be at least 10, 12, 14, 16, 18, 20 or 25 nucleotides in length. In some cases longer probes of at least 30, 40, or 50 nucleotides will be desirable.

As used herein, oligonueleotide sequences that are complementary to one or more of the genes described in Tables 1-6 refer to oligonucleotides that are capable of hybridizing under stringent conditions to at least part of the nucleotide sequence of said genes. Such hybridizable oligonucleotides will typically exhibit at least about 75% sequence identity at the nucleotide level to said genes, preferably about 80% or 85% sequence identity or more preferably about 90% or 95% or more sequence identity to said genes.

"Bind(s) substantially" refers to complementary hybridization between a probe nucleic acid and a target nucleic acid and embraces minor mismatches that can be accommodated by reducing the stringency of the hybridization media to achieve the desired detection of the target polynucleotide sequence.

The terms "background" or "background signal intensity" refer to hybridization signals resulting from non-specific binding, or other interactions, between the labeled target nucleic acids and components of the oligonucleotide array (e.g., the oligonucleotide probes, control probes, the array substrate, etc.). Background signals may also be produced by intrinsic fluorescence of the array components themselves. A single background signal can be calculated for the entire array, or a different background signal may be calculated for each target nucleic acid. In a preferred embodiment, background is calculated as the average hybridization signal intensity for the lowest 5% to 10% of the probes in the array, or, where a different background signal is calculated for each target gene, for the lowest 5% to 10% of the probes for each gene. Of course, one of skill in the art will appreciate that where the probes to a particular gene hybridize well and thus appear to be specifically binding to a target sequence, they should not be used in a background signal calculation. Alternatively, background may be calculated as the average hybridization signal intensity produced by hybridization to probes that are not complementary to any sequence found in the sample (e.g. probes directed to nucleic acids of the opposite sense or to genes not found in the sample such as bacterial genes where the sample is mammalian nucleic acids). Background can also be calculated as the average signal intensity produced by regions of the array that lack probes.

The phrase "hybridizing specifically to" refers to the binding, duplexing, or hybridizing of a molecule substantially to or only to a particular nucleotide sequence or sequences under stringent conditions when that sequence is present in a complex mixture (e.g., total cellular DNA or RNA).

Assays and methods of the invention may utilize available formats to simultaneously screen at least about 100, preferably about 1000, more preferably about 10,000 and most preferably about 1,000,000 different nucleic acid hybridizations.

As used herein a "probe" is defined as a nucleic acid molecule, capable of binding to a target nucleic acid of complementary sequence through one or more types of chemical bonds, usually through complementary base pairing, usually through hydrogen bond formation. As used herein, a probe may include natural (i.e., A, G, U, C, or T) or modified bases (7-deazaguanosine, inosine, etc.). In addition, the bases in probes may be joined by a linkage other than a phosphodiester bond, so long as it does not interfere with hybridization. Thus, probes may be peptide nucleic acids in which the constituent bases are joined by peptide bonds rather than phosphodiester linkages.

The term "stringent conditions" refers to conditions under which a probe will hybridize to its target subsequence, but with only insubstantial hybridization to other sequences or to other sequences such that the difference may be identified. Stringent conditions are sequence-dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH.

Typically, stringent conditions will be those in which the salt concentration is at least about 0.01 to 1.0 M Na ion concentration (or other salts) at pH 7.0 to 8.3 and the temperature is at least about 30° C. for short probes (e.g., 10 to 50 nucleotide). Stringent conditions may also be achieved with the addition of destabilizing agents such as formamide.

The "percentage of sequence identity" or "sequence identity" is determined by comparing two optimally aligned sequences or subsequences over a comparison window or span, wherein the portion of the polynucleotide sequence in the comparison window may optionally comprise additions or deletions (i.e., gaps) as compared to the reference sequence (which does not comprise additions or deletions) for optimal alignment of the two sequences.

The percentage is calculated by determining the number of positions at which the identical submit (e.g. nucleic acid base or amino acid residue) occurs in both sequences to yield the number of matched positions, dividing the number of matched positions by the total number of positions in the window of comparison and multiplying the result by 100 to yield the percentage of sequence identity. Percentage sequence identity when calculated using the programs GAP or BESTFIT (see below) is calculated using default gap weights.

Probe Design

One of skill in the art will appreciate that an enormous number of array designs are suitable for the practice of this invention. The high density array will typically include a number of probes that specifically hybridize to the sequences of interest. See WO 99/32660 for methods of producing probes for a given gene or genes. In addition, in a preferred embodiment, the array will include one or more control probes.

High density array chips of the invention include "test probes." Test probes could be oligonucleotides that range from about 5 to about 500 or 5 to about 45 nucleotides, more preferably from about 10 to about 40 nucleotides and most preferably from about 15 to about 40 nucleotides in length. In other particularly preferred embodiments the probes are 20 or 25 nucleotides in length. In another preferred embodiment, test probes are double or single strand DNA sequences. DNA sequences are isolated or cloned from natural sources or amplified from natural sources using native nucleic acid as templates. These probes have sequences complementary to particular subsequences of the genes whose expression they are designed to detect. Thus, the test probes are capable of specifically hybridizing to the target nucleic acid they are to detect (the genes of Tables 1-6).

The term "perfect match probe" refers to a probe that has a sequence that is perfectly complementary to a particular target sequence. The probe is typically perfectly complementary to a portion (subsequence) of the target sequence. The perfect match (PM) probe can be a "test probe", a "normalization control" probe, an expression level control probe and the like. A perfect match control or perfect match probe is, however, distinguished from a "mismatch control" or "mismatch probe."

In addition to test probes that bind the target nucleic acid(s) of interest, the high density array can contain a number of control probes. The control probes fall into three categories referred to herein as 1) normalization controls; 2) expression level controls; and 3) mismatch controls.

Normalization controls are oligonucleotide or other nucleic acid probes that are complementary to labeled reference oligonucleotides or other nucleic acid sequences that are added to the nucleic acid sample to be screened. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes thereby normalizing the measurements.

Virtually any probe may serve as a normalization control. However, it is recognized that hybridization efficiency varies with base composition and probe length. Preferred normalization probes are selected to reflect the average length of the other probes present in the array, however, they can be selected to cover a range of lengths. The normalization control(s) can also be selected to reflect the (average) base composition of the other probes in the array, however in a preferred embodiment, only one or a few probes are used and they are selected such that they hybridize well (i.e., no secondary structure) and do not match any target-specific probes.

Expression level controls are probes that hybridize specifically with constitutively expressed genes in the biological sample. Virtually any constitutively expressed gene provides a suitable target for expression level controls. Typically expression level control probes have sequences complementary to subsequences of constitutively expressed "housekeeping genes" including, but not limited to an actin gene, the transferrin receptor gene, the GAPDH gene, and the like.

Mismatch controls or mismatch probes may also be provided for the probes to the target genes, for expression level controls or for normalization controls. Mismatch controls are oligonucleotide probes or other nucleic acid probes identical to their corresponding test or control probes except for the presence of one or more mismatched bases. A mismatched base is a base selected so that it is not complementary to the corresponding base in the target sequence to which the probe would otherwise specifically hybridize. One or more mismatches are selected such that under appropriate hybridization conditions (e.g., stringent conditions) the test or control probe would be expected to hybridize with its target sequence, but the mismatch probe would not hybridize (or would hybridize to a significantly lesser extent). Preferred mismatch probes contain a central mismatch. Thus, for example, where a probe is a 20 mer, a corresponding mismatch probe will have the identical sequence except for a single base mismatch (e.g., substituting a G, a C or a T for an A) at any of positions 6 through 14 (the central mismatch).

Mismatch probes thus provide a control for non-specific binding or cross hybridization to a nucleic acid in the sample other than the target to which the probe is directed. Mismatch probes also indicate whether a hybridization is specific or not. For example, if the target is present the perfect match probes should be consistently brighter than the mismatch probes. In addition, if all central mismatches are present, the mismatch probes can be used to detect a mutation. The difference in intensity between the perfect match and the mismatch probe provides a good measure of the concentration of the hybridized material.

Nucleic Acid Samples

As is apparent to one of ordinary skill in the art, nucleic acid samples used in the methods and assays of the invention may be prepared by any available method or process. Methods of isolating total mRNA are well known to those of skill in the art. For example, methods of isolation and purification of nucleic acids are described in detail in Chapter 3 of *Laboratory Techniques in Biochemistry and Molecular Biology: Hybridization With Nucleic Acid Probes*, Part I Theory and Nucleic Acid Preparation, P. Tijssen, Ed., Elsevier, N.Y. (1993). Such samples include RNA samples, but also include cDNA synthesized from a mRNA sample isolated from a cell or tissue of interest. Such samples also include DNA amplified from the cDNA, and RNA transcribed from the amplified DNA. One of skill in the art would appreciate that it is desirable to inhibit or destroy RNase present in homogenates before homogenates can be used.

Biological samples may be of any biological tissue or fluid or cells from any organism as well as cells raised in vitro, such as cell lines and tissue culture cells. Biological samples may also include sections of tissues, such as frozen sections or formalin fixed sections taken for histological purposes. Frequently, the sample will be a "clinical sample" which is a sample derived from a patient. Typical clinical samples include, but are not limited to prostate tissue, urine, sputum, blood, blood-cells (e.g., white cells or peripheral blood leukocytes (PBL), tissue or fine needle biopsy samples, peritoneal fluid, and pleural fluid, or cells therefrom.

Forming High Density Arrays

Methods of forming high density arrays of oligonucleotides with a minimal number of synthetic steps are known. The oligonucleotide analogue array can be synthesized on a solid substrate by a variety of methods, including, but not limited to, light-directed chemical coupling, and mechanically directed coupling. See Pirrung et al., U.S. Pat. No. 5,143,854.

In brief, the light-directed combinatorial synthesis of oligonucleotide arrays on a glass surface proceeds using automated phosphoramidite chemistry and chip masking techniques. In one specific implementation, a glass surface is derivatized with a silane reagent containing a functional group, e.g., a hydroxyl or amine group blocked by a photolabile protecting group. Photolysis through a photolithogaphic mask is used selectively to expose functional groups which are then ready to react with incoming 5' photoprotected nucleoside phosphoramidites. The phosphoramidites react only with those sites which are illuminated (and thus exposed by removal of the photolabile blocking group). Thus, the phosphoramidites only add to those areas selectively exposed from the preceding step. These steps are repeated until the desired array of sequences have been synthesized on the solid surface. Combinatorial synthesis of different oligonucleotide analogues at different locations on the array is determined by the pattern of illumination during synthesis and the order of addition of coupling reagents.

In addition to the foregoing, additional methods which can be used to generate an array of oligonucleotides on a single substrate are described in WO 93/09668. High density nucleic acid arrays can also be fabricated by depositing premade or natural nucleic acids in predetermined positions. Synthesized or natural nucleic acids are deposited on specific locations of a substrate by light directed targeting and oligonucleotide directed targeting. Another embodiment uses a dispenser that moves from region to region to deposit nucleic acids in specific spots.

Hybridization

Nucleic acid hybridization simply involves contacting a probe and target nucleic acid under conditions where the probe and its complementary target can form stable hybrid duplexes through complementary base pairing. See WO 99/32660. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary.

Thus specificity of hybridization is reduced at lower stringency. Conversely, at higher stringency (e.g., higher temperature or lower salt) successful hybridization tolerates fewer mismatches. One of skill in the art will appreciate that hybridization conditions may be selected to provide any degree of stringency. In a preferred embodiment, hybridization is performed at low stringency in this case in 6× SSPE-T at 37° C. (0.005% Triton X-100) to ensure hybridization and then subsequent washes are performed at higher stringency (e.g., 1× SSPE-T at 37° C.) to eliminate mismatched hybrid duplexes. Successive washes may be performed at increasingly higher stringency (e.g., down to as low as 0.25× SSPET at 37° C. to 50° C.) until a desired level of hybridization specificity is obtained. Stringency can also be increased by addition of agents such as formamide. Hybridization specificity may be evaluated by comparison of hybridization to the test probes with hybridization to the various controls that can be present (e.g., expression level control, normalization control, mismatch controls, etc.).

In general, there is a tradeoff between hybridization specificity (stringency) and signal intensity. Thus, in a preferred embodiment, the wash is performed at the highest stringency that produces consistent results and that provides a signal intensity greater than approximately 10% of the background intensity. Thus, in a preferred embodiment, the hybridized array may be washed at successively higher stringency solutions and read between each wash. Analysis of the data sets thus produced will reveal a wash stringency above which the hybridization pattern is not appreciably altered and which provides adequate signal for the particular oligonucleotide probes of interest.

Signal Detection

The hybridized nucleic acids are typically detected by detecting one or more labels attached to the sample nucleic acids. The labels may be incorporated by any of a number of means well known to those of skill in the art. See WO 99/32660.

Databases

The present invention includes relational databases containing sequence information, for instance for the genes of Tables 1-6, as well as gene expression information in various prostate tissue samples. Databases may also contain information associated with a given sequence or tissue sample such as descriptive information about the gene associated with the sequence information, metabolic pathway information for the gene or descriptive information concerning the clinical status of the tissue sample, or the patient from which the sample was derived. Such information for the patient may include, but is not limited to sex, age, disease status, general health information, surgical or treatment status, PSA levels, as well as information concerning the patient's clinical symptoms. The database may be designed to include different parts, for instance a sequence database and a gene expression database. Methods for the configuration and construction of such databases are widely available, for instance, see U.S. Pat. No. 5,953,727, which is herein incorporated by reference in its entirety.

The databases of the invention may be linked to an outside or external database. In a preferred embodiment, as described in Tables 1-6, the external database is GenBank and the associated databases maintained by the National Center for Biotechnology Information (NCBI).

Any appropriate computer platform may be used to perform the necessary comparisons between sequence information, gene expression information and any other information in the database or provided as an input. For example, a large number of computer workstations are available from a variety of manufacturers, such has those available from Silicon Graphics. Client/server environments, database servers and networks are also widely available and appropriate platforms for the databases of the invention.

The databases of the invention may be used to produce, among other things, electronic Northerns that allow the user to determine the cell type or tissue in which a given gene is expressed and to allow determination of the abundance or expression level of a given gene in a particular tissue or cell.

The databases of the invention may also be used to present information identifying the expression level in a tissue or cell of a set of genes comprising at least two of the genes in Tables 1-6, comprising the step of comparing the expression level of at least one gene in Tables 1-6 found or detected in the tissue to the level of expression of the gene in the database. Such methods may be used to predict the hyperplastic state of a given tissue by comparing the level of expression of a gene or genes in Tables 1-6 from a sample to the expression levels found in normal prostate cells, BPH cells or tissue and/or malignant or cancerous prostate tissue. Such methods may also be used in the drug or agent screening assays as described below.

Selection of BPH-Associated Genes

BPH associated genes may be identified or selected by any available method, including subtractive hybridization protocols, differential display protocols and high-throughput hybridization formats, including oligonucleotide and cDNA microarray technologies.

Unprocessed or raw expression levels may be normalized, standardized and/or analyzed by any available computational method, including the expression level normalization, analysis and clustering methods herein described. The normalization method as described in Example 4 may be combined with any further analysis method, including any clustering methods available in the art.

Diagnostic Uses for the BPH Markers

As described above, the genes and gene expression information provided in Tables 1-1s 6 may be used as diagnostic markers for the prediction or identification of the hyperplastic state of a prostate or other tissue. For instance, a prostate tissue or other patient sample may be assayed by any of the methods described above, and the expression levels from a gene or genes from Tables 1-6 may be compared to the expression levels found in normal prostate tissue, BPH tissue or BPH tissue from a patient with metastatic or nonmetastatic prostate cancer. In some instances, patient PBLs may be used as the patient sample. The comparison of expression data, as well as available sequence or other information may be done by researcher or diagnostician or may be done with the aid of a computer and databases as described above.

Use of the BPH Markers for Monitoring Disease Progression

As described above, the genes and gene expression information provided in Tables 1-6 may also be used as markers for the monitoring of disease progression, such as the development of BPH. For instance, a prostate tissue or other patient sample may be assayed by any of the methods described above, and the expression levels from a gene or genes from Tables 1-6 may be compared to the expression levels found in normal prostate tissue, BPH tissue or BPH tissue from a patient with metastatic or nonmetastatic prostate cancer. The comparison of the expression data, as well as available sequence or other information may be done by researcher or diagnostician or may be done with the aid of a computer and databases as described above.

The BPH markers of the invention may also be used to track or predict the progress or efficacy of a treatment regime in a patient. For instance, a patient's progress or response to a given drug may be monitored by creating a gene expression profile from a tissue or cell sample after treatment or administration of the drug. The gene expression profile may then be compared to a gene expression profile prepared from normal cells or tissue, for instance, normal prostate tissue. The gene expression profile may also be compared to a gene expression profile prepared from BPH or malignant prostate cells, or from tissue or cells from the same patient before treatment. The gene expression profile may be made from at least one gene, preferably more than one gene, and most preferably all or nearly all of the genes in Tables 1-6.

Use of the BPH Markers for Drug Screening

According to the present invention, the genes identified in Tables 1-6 can be used as markers to screen for potential therapeutic agents or compounds to treat BPH or prostate cancer. A candidate drug or agent can be screened for the ability to stimulate the transcription or expression of a given marker or to down-regulate or counteract the transcription or expression of a marker or markers. Compounds that modulate the expression level of single gene and also compounds that modulate the expression level of multiple genes from levels associated with a specific disease state to a normal state can be screened by using the markers and profiles identified herein.

According to the present invention, one can also compare the specificity of drug's effects by looking at the number of markers which are differentially expressed after drug exposure and comparing them. More specific drugs will have less transcriptional targets. Similar sets of markers identified for two drugs may indicate a similarity of effects.

Assays to monitor the expression of a marker or markers as defined in Tables 1-6 may utilize any available means of monitoring for changes in the expression level of the nucleic acids of the invention. As used herein, an agent is said to modulate the expression of a nucleic acid of the invention if it is capable of up- or down-regulating expression of the nucleic acid in a cell.

In one assay format, gene chips containing probes to at least 2 genes from Tables 1-6 may be used to directly monitor or detect changes in gene expression in the treated or exposed cell as described in more detail above. In another format, the changes of mRNA expression level can be detected using QuantiGene technology (Warrior et. al. (2000) *J. Biomolecular Screening*, 5, 343-351). Specific probes used for QuantiGene can be designed and synthesized to one or more genes from Tables 1-6. Cells treated with compounds are lysed by lysis buffer. The amount of target mRNA can be detected as a luminescence intensity using target specific probes.

In another format, cell lines that contain reporter gene fusions between the open reading frame and/or 5'/3' regulatory regions of a gene in Tables 1-6 and any assayable fusion partner may be prepared. Numerous assayable fusion partners are known and readily available including the firefly luciferase gene and the gene encoding chloramphenicol acetyltransferase (Alam et al. (1990) *Anal. Biochem.* 188: 245-254). Cell lines containing the reporter gene fusions are then exposed to the agent to be tested under appropriate conditions and time. Differential expression of the reporter gene between samples exposed to the agent and control samples identifies agents which modulate the expression of the nucleic acid.

Additional assay formats may be used to monitor the ability of the agent to modulate the expression of a gene identified in Tables 1-6. For instance, as described above, mRNA expression may be monitored directly by hybridization of probes to the nucleic acids of the invention. Cell lines are exposed to the agent to be tested under appropriate conditions and time and total RNA or mRNA is isolated by standard procedures such those disclosed in Sambrook et al.

(*Molecular Cloning: A Laboratory Manual,* 2nd Ed. Cold Spring Harbor Laboratory Press, 1989).

In another assay format, cells or cell lines are first identified which express the gene products of the invention physiologically (see below). Cell and/or cell lines so identified would be expected to comprise the necessary cellular machinery such that the fidelity of modulation of the transcriptional apparatus is maintained with regard to exogenous contact of agent with appropriate surface transduction mechanisms and/or the cytosolic cascades. Such cell lines may be, but are not required to be, prostate derived. Further, such cells or cell lines may be transduced or transfected with an expression vehicle (e.g., a plasmid or viral vector) construct comprising an operable non-translated 5'-promoter containing end of the structural gene encoding the instant gene products fused to one or more antigenic fragments, which are peculiar to the instant gene products, wherein said fragments are under the transcriptional control of said promoter and are expressed as polypeptides whose molecular weight can be distinguished from the naturally occurring polypeptides or may further comprise an immunologically distinct tag or some other detectable marker or tag. Such a process is well known in the art (see Maniatis).

Cells or cell lines transduced or transfected as outlined above are then contacted with agents under appropriate conditions; for example, the agent comprises a pharmaceutically acceptable excipient and is contacted with cells comprised in an aqueous physiological buffer such as phosphate buffered saline (PBS) at physiological pH, Eagles balanced salt solution (BSS) at physiological pH, PBS or BSS comprising serum or conditioned media comprising PBS or BSS and/or serum incubated at 37° C. Said conditions may be modulated as deemed necessary by one of skill in the art. Subsequent to contacting the cells with the agent, said cells are disrupted and the polypeptides of the lysate are fractionated such that a polypeptide fraction is pooled and contacted with an antibody to be further processed by immunological assay (e.g., ELISA, immunoprecipitation or Western blot). The pool of proteins isolated from the "agent-contacted" sample is then compared with a control sample where only the excipient is contacted with the cells and an increase or decrease in the immunologically generated signal from the "agent-contacted" sample compared to the control is used to distinguish the effectiveness of the agent.

Another embodiment of the present invention provides methods for identifying agents that modulate at least one activity of a protein(s) encoded by the genes in Tables 1-6. Such methods or assays may utilize any means of monitoring or detecting the desired activity.

In one format, the relative amounts of a protein of the invention between a cell population that has been exposed to the agent to be tested compared to an un-exposed control cell population may be assayed. In this format, probes such as specific antibodies are used to monitor the differential expression of the protein in the different cell populations. Cell lines or populations are exposed to the agent to be tested under appropriate conditions and time. Cellular lysates may be prepared from the exposed cell line or population and a control, unexposed cell line or population. The cellular lysates are then analyzed with the probe, such as a specific antibody.

Agents that are assayed in the above methods can be randomly selected or rationally selected or designed. As used herein, an agent is said to be randomly selected when the agent is chosen randomly without considering the specific sequences involved in the association of the a protein of the invention alone or with its associated substrates, binding partners, etc. An example of randomly selected agents is the use a chemical library or a peptide combinatorial library, or a growth broth of an organism.

As used herein, an agent is said to be rationally selected or designed when the agent is chosen on a nonrandom basis which takes into account the sequence of the target site and/or its conformation in connection with the agent's action. Agents can be rationally selected or at rationally designed by utilizing the peptide sequences that make up these sites. For example, a rationally selected peptide agent can be a peptide whose amino acid sequence is identical to or a derivative of any functional consensus site.

The agents of the present invention can be, as examples, peptides, small molecules, vitamin derivatives, as well as carbohydrates. Dominant negative proteins, DNAs encoding these proteins, antibodies to these proteins, peptide fragments of these proteins or mimics of these proteins may be introduced into cells to affect function. "Mimic" used herein refers to the modification of a region or several regions of a peptide molecule to provide a structure chemically different from the parent peptide but topographically and functionally similar to the parent peptide (see Grant G A. in: Meyers (ed.) Molecular Biology and Biotechnology (New York, VCH Publishers, 1995), pp. 659-664). A skilled artisan can readily recognize that there is no limit as to the structural nature of the agents of the present invention.

Cells Used for Multi Gene Screening

Many kinds of cells such as primary cells and cell lines can be used for the drug screening methods of the invention. Cells or cell lines derived from prostatic tissues are preferred because the innate gene expression mechanisms of these cells often resemble those of prostatic tissues. Cells used for drug screening can be selected by assaying for the expression of one or more of the marker genes listed in Tables 1-6. The cells which differentially express one or more, or preferably nearly all of the marker genes listed in Tables 1-6 are preferred cells or cell lines for the methods of the invention (see Table 7).

Kits

The invention further includes kits combining, in different combinations, high-density oligonucleotide arrays, reagents for use with the arrays, signal detection and array-processing instruments, gene expression databases and analysis and database management software described above. The kits may be used, for example, to diagnose the disease state of a tissue or cell sample, to monitor the progression of prostate disease states, to identify genes that show promise as new drug targets and to screen known and newly designed drugs as discussed above.

The databases packaged with the kits are a compilation of expression patterns from human and laboratory animal genes and gene fragments (corresponding to the genes of Tables 1-6). In particular, the database software and packaged information include the expression results of Tables 1-6 that can be used in the assays and methods as herein described. In another format, database access is provided to the purchaser or user through an electronic means, e.g., via the Internet or by direct dial-in access.

The kits may used in the pharmaceutical industry, where the need for early drug testing is strong due to the high costs associated with drug development, but where bioinformatics, in particular gene expression informatics, is still lacking. These kits will reduce the costs, time and risks associated with traditional new drug screening using cell cultures and laboratory animals. The results of large-scale drug screening of pre-grouped patient populations, pharmacogenomics testing, can also be applied to select drugs with greater efficacy and fewer side-effects. The kits may also be used by smaller biotechnology companies and research institutes who do not have the facilities for performing such large-scale testing themselves.

Databases and software designed for use with use with microarrays is discussed in Balaban et al., U.S. Pat. No. 6,229,911, a computer-implemented method for managing information, stored as indexed tables, collected from small or large numbers of microarrays, and U.S. Pat. No. 6,185,561, a computer-based method with data mining capability for collecting gene expression level data, adding additional attributes and reformatting the data to produce answers to various queries. Chee et al., U.S. Pat. No. 5,974,164, disclose a software-based method for identifying mutations in a nucleic acid sequence based on differences in probe fluorescence intensities between wild type and mutant sequences that hybridize to reference sequences.

Without further description, it is believed that one of ordinary skill in the art can, using the preceding description and the following illustrative examples, make and utilize the genes, chips, etc. of the present invention and practice the claimed methods. The following working examples therefore, specifically point out the preferred embodiments of the present invention, and are not to be construed as limiting in any way the remainder of the disclosure.

EXAMPLES

Example 1

Gene Chip Expression Analysis

Human tissue was obtained from the transitional zone of the prostate (the junction between the ejaculatory duct and the prostatic urethra) in biopsy samples from normal individuals and from patients with BPH or prostate cancer. BPH was defined histologically in all samples. Normal tissue and asymptomatic BPH samples came from individuals who died of trauma and did not report symptoms. Because BPH is a disease associated with aging, two groups of normal individuals were identified, group 1, ages 20 or under, and group 2, ages 30-50. Patients having BPH with symptoms were defined as those with a need for frequent urination. In these patients, a radical prostatectomy had been performed. Prostate cancer patients provided age-matched tissue samples for symptomatic BPH patients, but were without symptoms and without cancer in the transitional zone under histological examination.

Microarray sample preparation was conducted with minor modifications, following the protocols set forth in the Affymetrix GeneChip Expression Analysis Manual. Frozen tissue was ground to a powder using a Spex Certiprep 6800 Freezer Mill. Total RNA was extracted with Trizol (Gibco-BRL) utilizing the manufacturer's protocol. The total RNA yield for each sample was 200-500 µg per 300 mg tissue weight. mRNA was isolated using the Oligotex mRNA Midi kit (Qiagen) followed by ethanol precipitation. Double stranded cDNA was generated from mRNA using the SuperScript Choice system (GibcoBRL). First strand cDNA synthesis was primed with a T7-(dT24) oligonucleotide. The cDNA was phenol-chloroform extracted and ethanol precipitated to a final concentration of 1 µg/ml. From 2 µg of cDNA, cRNA was synthesized using Ambion's T7 MegaScript in vitro Transcription Kit.

To biotin label the cRNA, nucleotides Bio-11-CTP and Bio-16-UTP (Enzo Diagnostics) were added to the reaction. Following a 37° C. incubation for six hours, impurities were removed from the labeled cRNA following the RNeasy Mini kit protocol (Qiagen). cRNA was fragmented (fragmentation buffer consisting of 200 mM Tris-acetate, pH 8.1, 500 mM KOAc, 150 mM MgOAc) for thirty-five minutes at 94° C. Following the Affymetrix protocol, 55 µg of fragmented cRNA was hybridized on the Affymetrix Human 42K array set for twenty-four hours at 60 mpm in a 45° C. hybridization oven. The chips were washed and stained with Streptavidin Phycoerythrin (SAPE) (Molecular Probes) in Affymetrix fluidics stations. To amplify staining, SAPE solution was added twice with an anti-streptavidin biotinylated antibody (Vector Laboratories) staining step in between. Hybridization to the probe arrays was detected by fluorometric scanning (Hewlett Packard Gene Array Scanner). Data was analyzed using Affymetrix GeneChip version 3.0 and Expression Data Mining Tool (EDMT) software (version 1.0).

Differential expression of genes between the BPH and normal prostate samples were determined using the Affymetrix GeneChip human gene chip set by the following criteria: 1) For each gene, Affymetrix GeneChip average difference values were determined by standard Affymetrix EDMT software algorithms, which also made "Absent" (=not specifically detected as gene expression), "Present" (=detected) or "Marginal" (=not clearly Absent or Present) calls for each GeneChip element; 2) all AveDiff values which were less than +20 (positive 20) were raised to a floor of +20 so that fold change calculations could be made where values were not already greater than or equal to +20; 3) median levels of expression were compared between the normal control group and the BPH with symptoms disease group to obtain greater than or equal 2-fold up/down values; 4) The median value for the higher expressing group needed to be greater or equal to 200 average difference units in order to be considered for statistical significance; 5) Genes passing the criteria of #1-4 were analyzed for statistical significance using a two-tailed T test and deemed statistically significant if p<0.05. Tables 1 and 2 list the genes and their levels of differential expression (compared to normal samples) in BPH tissue from patients with symptoms of BPH and in BPH tissue immediately adjacent to malignant prostate tissue isolated from male patients.

Example 2

Expression Profile Analysis

Gene expression profiles between normal sample and BPH patient samples were determined by using the following samples: 10 normal; 7 BPH without symptoms; 8 BPH with cancer; and 8 BPH with symptoms. Gene expression profiles were prepared using the 42K Affymetrix Gene Chip set. The methods used were the same as described in Example 1 with the exception of the criteria to select the marker genes.

The criteria used in this study were as follows; 1) For each gene, Affymetrix GeneChip average difference values were determined by standard Affymetrix EDMT software algorithms, which also made "Absent" (=not specifically detected as gene expression), "Present" (=detected) or "Marginal" (=not clearly Absent or Present) calls for each GeneChip element; 2) all AveDiff values which were less than +20 (positive 20) were raised to a floor of +20 so that fold change calculations could be made where values were not already greater than or equal to +20; 3) mean levels of expression were compared between the normal control group and the BPH with symptoms disease group; 4) genes were arranged by the fold change starting with the largest one (Fold change calculation was determined by using logarithmic values in Example 2); and 5) the top 200 up-regulated genes and bottom 200 down-regulated genes were selected. The genes identified in this study are listed in Tables 3 (normal vs. BPH with symptoms, up regulated) and 4 (normal vs. BPH with symptoms, down regulated, values are negative fold-change from normal).

Example 3

Selection of Cell Lines Used for Multi Gene Screening

A number of cultured cell lines were tested to determine the similarity in gene expression profiles to BPH tissue. Cells were cultured in 6-well plates using the appropriate medium for each cell line. After reaching 90% confluency, cells were lysed with Trizol (GiboBRL) and total RNA was extracted. mRNA was then isolated, cDNA and cRNA was synthesized, and gene expression levels were determined by the Affymetrix Human 42K Gene Chip set as described in more detail above.

The gene expression profiles were compared with those of prostatic tissue samples. A panel of 61 genes whose expression levels were up-regulated in BPH with symptoms compared with normal samples and with small variation among samples (within BPH samples and within normal samples) were assayed. The group of genes whose signal intensity was more than 100 in each cell line is summarized in Table 1. A panel of 43 genes whose expression levels were down-regulated in BPH patient with small variation among samples was also assayed. The group of genes whose signal intensity in Affymetrix Gene Chip was "Present call" is also included in Table 1. Similarly, genes whose expression level is up- or down-regulated in patients with BPH and cancer, compared to normal controls, are listed in Table 2.

Forty-eight to 58% of genes applied for this analysis were expressed in the cell lines of Table 7. These results indicate that cell lines, BRF-55T (Biological Research Faculty & Facility Inc.), PZ-HPV7 (ATCC; CRL-2221), BPH-1 (S. W. Hayward et al., *In Vitro Cell Dev. Biol.* 31A, 14-24, 1995) and LNCaP (ATCC; CRL-1740) can be used as a BPH—like cell population to screen for compounds which are capable of modulating gene expression profiles from the disease state to a normal state using the genes of Tables 1-6. In particular, BRF-55T is a useful cell line for screening in the assays of the invention, because 58% genes of the assayed genes were differentially expressed in BRF-55T as compared to BPH with symptoms tissue.

Example 4

Cluster Analysis of Up- or Down-regulated Genes in BPH

Cluster analysis of the expression results from a large number of genes is often problematic due to variations in the standardization of the gene expression data. To compensate for these variations, a subset of differentially expressed genes was selected by a modified analysis procedure.

In a first step, a gene list comparing normal vs. disease samples was generated by two kinds of comparisons. First, genes were selected that displayed a greater than or equal to mean 2-fold up or down regulation using average difference expression values and with $p<0.05$. Second, genes were selected by ANOVA comparing the normal group of samples with the disease group and with a t value of >3 in the up or down direction. These lists were then combined to create an expression profile characteristic of normal controls and one characteristic of disease in which specific genes are found to be up or down regulated in disease when compared with normal controls.

In preparation for clustering analysis to identify subgroups of genes that show statistically similar expression patterns, average difference values for the selected genes were normalized across all samples (normal and disease combined) using the following formula:

Normalization data=$(X-Xmean)/Sx$

Where Sx is variance (:STD)

This converts the mean expression value for each gene to 0 and the high and low values to 1 and −1, respectively. Thus, genes with high absolute expression values when compared with genes with low absolute expression values would not skew the comparisons when clustering algorithms are applied.

The measurement of the cluster space distance was determined by using the correlation coefficient (1-r) method and clustering was performed using Ward's method (Ward, J. H. (1963) *Journal of American Statistical Association*, 58. 236.)

The clustering was validated by observing whether multiple elements representing the same genes showing the same direction of expression change (i.e., either up or down) tend to cluster together. To test this standardization and clustering protocol, the expression levels for genes that are represented by more than one element on the 42K gene chip set were analyzed to determine whether the multiple elements for a single gene could be clustered together. For example, tryptase, also known as alpha tryptase or beta (tryptase II) is represented by two separate elements on the 42K human gene chip. This gene is registered with 2 different element names 41268 (5), M33493_s_at (code name, Up-170) and 26389 (3), rc_AA131322_s_at (code name, Up-010).

It was found that the best analysis means for decreasing measurement errors between these two elements is by the Ward method as it gave the most consistent results when compared to other clustering methods. These analysis methods may be incorporated into software or computer readable storage media for storing a computer programmer software.

Example 5

Selection of 60 Marker Genes

A panel of 60 representative marker genes (listed in Table 5) out of 400 marker genes listed in Tables 3 and 4 can be used in the assays and methods of the invention. The 60 marker genes were selected based on following criteria: (1) expression level is changed greatly in BPH patient samples compared with normal samples; (2) variation of expression levels within BPH samples and within normal samples is small; and (3) expression levels resembling BPH with symptoms are detected in cell line BRF-55T.

Example 6

Gene Expression Analysis of Select Genes

The expression levels of three genes from Tables 1-5 (the genes encoding cellular retinol binding protein, S100 calcium binding protein and PSMA) were assayed in various tissues and prostate samples by PCR as described in Example 7 (see FIGS. 1-6). Each sample was assayed for the level of GAPDH and mRNA corresponding to cellular retinol binding protein, S100 calcium binding protein or PSMA. As seen in FIGS. 1-6, these three genes are differentially regulated or expressed in BPH tissue from patients with or without symptoms and from BPH tissue from patients with prostate cancer (compared to normal prostate tissue). All three genes are therefore useful markers in the assays of the invention, such as the assays to measure the effect of an agent on BPH or the assays to detect or diagnose the occurrence or progression of BPH.

Example 7

Drug Screening Assays

The expression profiles for normal controls and disease samples described above can be used to identify compound hits from a compound library. A hit may be, but is not necessarily, defined as one of three kinds of results:

1) The expression of an individual gene is changed in the direction of normal (i.e., if UP in disease, then down-hit, if down in disease, then up=hit). The stronger the modulation of an individual gene to a normnal phenotype, the stronger the hit status for the compound against that gene.

2) The expression of genes that sub cluster together is evaluated for an overall pattern of modulation to a normal expression profile. The more genes in a subcluster that are modulated to a normal phenotype, the stronger the hit status for the compound against that subcluster. A subcluster may represent common or interacting cellular pathways.

3) The overall expression profile of all of the genes being screened is evaluated for modulation to normal. The more genes that are modulated to a normal phenotype, the stronger the hit status for the compound against the entire gene set.

As described above, if a compound modulates the gene expression pattern of the screening system cells more towards any disease phenotype, then it can be used as a molecular probe to find binding proteins and/or define disease-associated cellular pathways.

As an example, candidate agents and compounds are screened for their ability to modulate the expression levels of cellular retinol binding protein, S100 calcium binding protein and PSMA by exposing a prostate cell line or cell line from BPH tissue to the agent and assaying the expression levels of these genes by real time PCR. Real time PCR detection is accomplished by the use of the ABI PRISM 7700 Sequence Detection System. The 7700 measures the fluorescence intensity of the sample each cycle and is able to detect the presence of specific amplicons within the PCR reaction. Each sample is assayed for the level of GAPDH and mRNA corresponding to cellular retinol binding protein, S100 calcium binding protein and PSMA. GAPDH detection is performed using Perkin Elmer part#402869 according to the manufacturer's directions. Primers were designed for the three genes by using Primer Express, a program developed by PE to efficiently find primers and probes for specific sequences ((1) N91971-FAM PROBE Forward: 5'-CAT ggC TTT gTT TTA AgA AAA ggA A-3'; Reverse: 5'-AgC CAC CCC CAg gCA T-3'; Probe: 5'-FAM-AgT gAC AAA gCC AAg AgA CAg ACT CTg CTA ACA-TAMRA-3'; (2) X65614-SYBR; Forward: 5'-AAA gAC AAg gAT gCC gTg gAT-3'; Reverse 5'-AgC CAC gAA CAC gAT gAA CTC-3'; (3) M99487-SYB; Forward 5'-Tgg CTC AgC ACC ACC Aga T-3'; Reverse: 5'-TTC Cag TAA AgC Cag gTC CAA-3')

These primers are used in conjunction with SYBR green (Molecular Probes), a nonspecific double stranded DNA dye, to measure the expression level mRNA corresponding to the genes, which is normalized to the GAPDH level in each sample.

Normalized expression levels from cells exposed to the agent are then compared to the normalized expression levels in control cells. Agents that modulate the expression of one or more the genes may be further tested as drug candidates in appropriate BPH in vitro or in vivo models.

Example 8

Comparative Assays

The expression of a panel of marker genes was compared, in the same subjects as disclosed in Example 2, in a pairwise fashion between the BPH patients with (BPHWS) or without (BPHNoS) symptoms versus normal (Normal) controls and asymptomatic BPH patients with cancer (Cancer). In every case, the tissue was excised from the junction between the ejaculatory duct and the prostatic urethra in the transition zone of the prostate. In particular, BPH tissue from patients with early stage prostate cancer was carefully excised away from the cancer lesion macroscopically, and their histological diagnosis was confirmed microscopically.

Pairwise comparisons between the subject groups were subjected to an Analysis of Variance (ANOVA) model. P-values corresponding to each of six possible pairwise comparisons among the four sample groups were then determined for each gene. Table 6 depicts Affymetrix fragments, along with their GenBank accession number, which have $p<0.001$ for two or more of the pairwise comparisons.

A Principal Component Analysis (PCA) was performed to show that this gene set serves as a basis to discriminate among the various groups of samples. The samples are plotted using the scores for the first three principal components. Each of the four sample groups can be clearly distinguished from one another in this analysis (FIG. 7A). Component 1 (36% of the variability) discriminates between Normal and asymptomatic BPH versus BPH cancer and symptomatic BPH. Component 2 (10% of the variability) distinguishes Normal from asymptomatic BPH, and Component 3 (8% of the variability) distinguishes BPH cancer from symptomatic BPH.

Figure 7B:
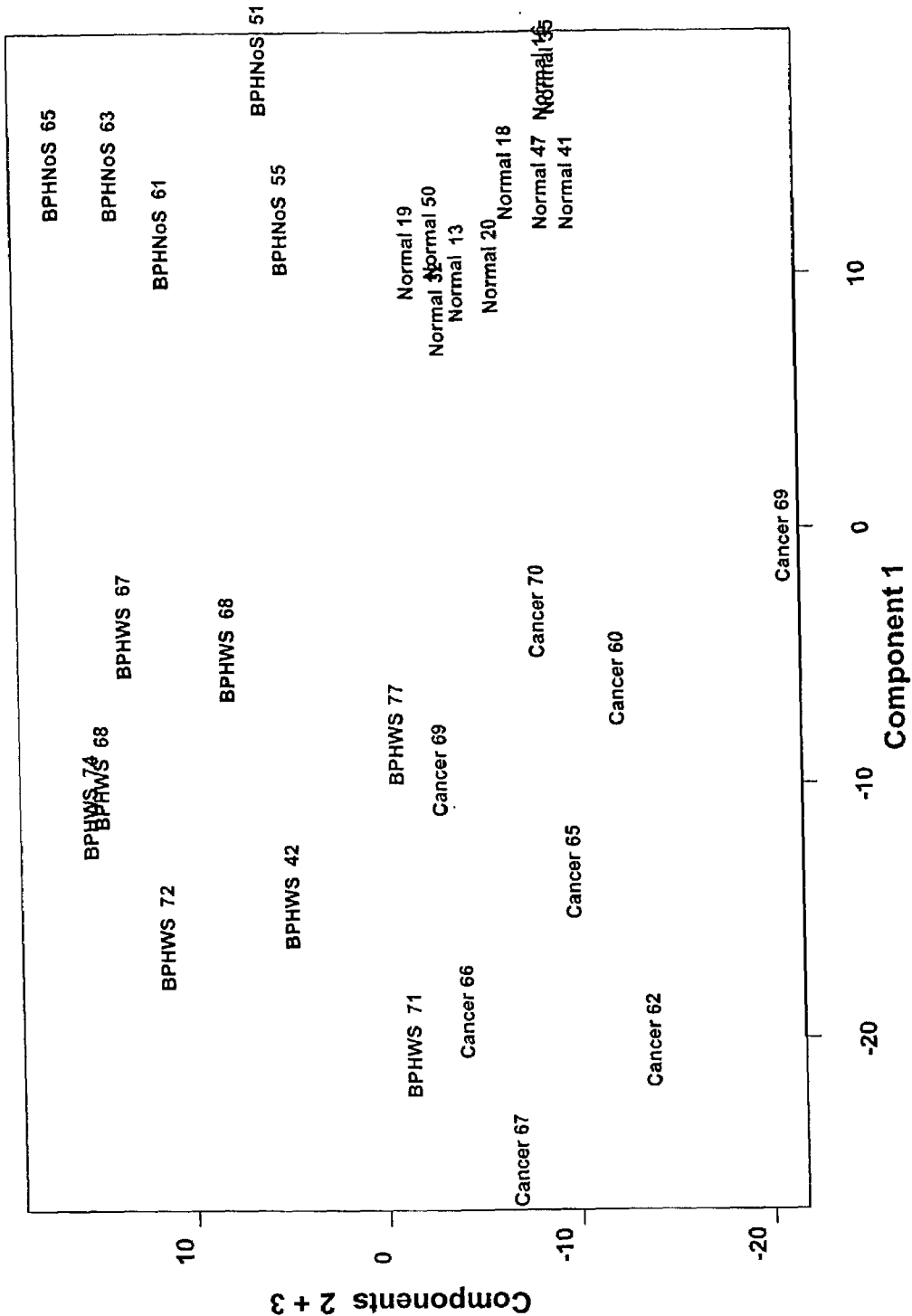

FIG. 7B shows a two-dimensional representation of the PCA, with Component 1 plotted against Components 2+3. Each of the four sample groups is clustered in a different quadrant of this figure. Within each sample group, there does not appear to be any age-related clustering of samples. Further, since there is an overlap of ages between the samples groups, it does not appear that age was a confounding factor for the analysis based on this gene set. Because BPH is perceived as a natural consequence of aging, two subgroups of normal individuals were initially identified. A 'younger' set included individuals ranging in age from 13-20 years while the 'older' set ranged from 31-51 years. However, because the two subsets appeared to be indistinguishable at the molecular level, they were grouped together and in all subsequent analysis referred to as 'Normal' group.

Another finding was that the intra-group variability (i.e., the tightness of clustering) differed between the four groups (FIG. 7A). Normal patients exhibited the least intra-group variability, followed by asymptomatic BPH and symptomatic BPH with BPH cancer patients exhibiting the most patient-to-patient variability. On the other hand, with regard to the inter-group variation, the asymptomatic BPH group appeared to be more similar to the normal group than to symptomatic BPH (FIG. 7B).

Figure 7C:
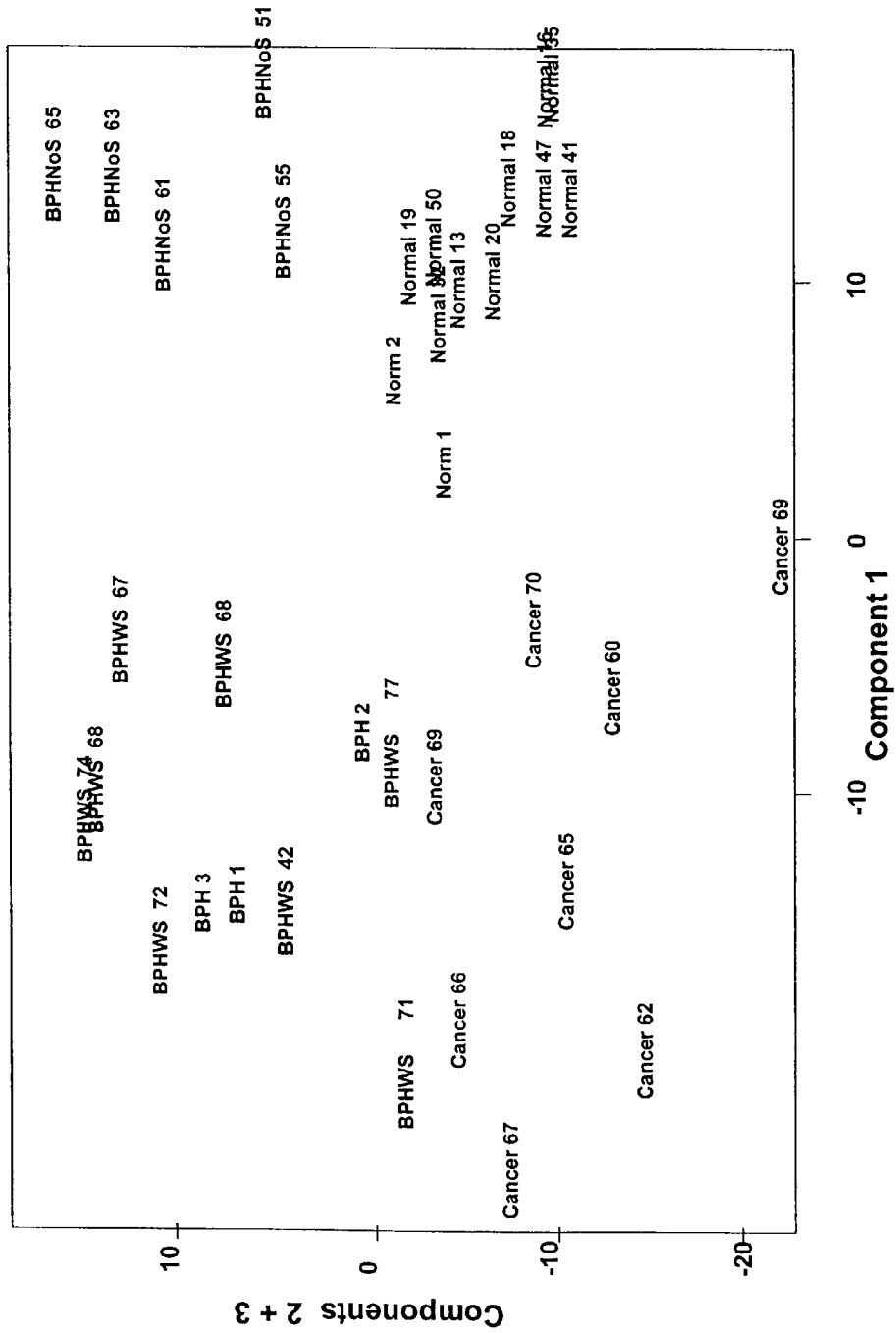

Asymptomatic BPH samples were obtained from individuals that died from other causes and had no records of being treated for BPH but had histological evidence for BPH when examined retrospectively. Since asymptomatic samples clearly exhibit the BPH phenotype at the microscopic level, one would expect the two BPH groups to exhibit more similarity than disparity. Similarly, that the BPH cancer group is distinct from asymptomatic BPH but is more similar to the symptomatic BPH group (FIG. 7B). Since transition zone tissue from patients with prostate cancer with no clinical symptoms of BPH was analyzed from these patients, this group of patients would be expected to appear similar to normal or asymptomatic BPH. The fact that the BPH cancer group can be distinguished from every other group is also an unexpected finding. Subsequent to this PCA, additional samples were studied to extend these findings. These included two normals and three symptomatic BPH patients. Using the same set of genes, a PCA was performed with these additional samples. In FIG. 7C, the two new normal (Norm) samples group with the previous normal samples and the three new symptomatic BPH (BPH) samples group with the other symptomatic BPH samples.

Example 9

Diagnostic Assays

The expression profiles of one or more of the individual genes of Tables 1-6 are used as molecular or diagnostic markers to evaluate the disease status of a patient sample. In one embodiment, a patient prostate tissue sample is processed as described herein to produce total cellular or mRNA. The RNA is hybridized to a chip comprising probes that specifically hybridize to one or more, or two or more of the genes in Tables 1-6. The overall expression profile generated, or the expression levels of individual genes are then compared to the profiles as described in Tables 1-6 to determine the disease or hyperplastic state of the patient sample.

Although the present invention has been described in detail with reference to examples above, it is understood that various modifications can be made without departing from the spirit of the invention. Accordingly, the invention is limited only by the following claims. All cited patents, applications, GenBank Accession numbers and publications referred to in this application are herein incorporated by reference in their entirety.

TABLE 1

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| Up-regulated | RC_AA410383_at | 277 | AA410383 | B-cell-homing chemokine (ligand for Burkitt's lymphoma receptor-1)4q21 | 22.5 | 0.025197485 |
| | RC_AA463726_s_at | 386 | AA463726 | JM27 proteinXp11.23 | 14.9 | 0.018598344 |
| | RC_AA057195_at | 47 | AA057195 | Homo sapiens mRNA; cDNA DKFZp586M121 (from clone DKFZp586M121) | 14.0 | 0.029325045 |
| | V01512_rna1_at | 993 | V01512 | v-fos FBJ murine osteosarcoma viral oncogene homolog14q24.3 | 13.1 | 0.001027561 |
| | RC_AA427622_s_at | 311 | AA427622 | collagen, type XIII, alpha 110q22 | 11.6 | 0.00074954 |
| | RC_N23730_s_at | 724 | N23730 | v-fos FBJ murine osteosarcoma viral oncogene homolog14q24.3 | 11.4 | 0.000631487 |
| | RC_AA465491_at | 391 | AA465491 | Mad4 homolog4p16.3 | 11.4 | 0.031024189 |
| | RC_AA620825_at | 454 | AA620825 | ESTs | 11.3 | 0.010915901 |
| | RC_R93908_at | 865 | R93908 | ESTs | 11.3 | 0.019994337 |
| | RC_AA461300_at | 381 | AA461300 | ESTs | 11.0 | 0.007061759 |
| | N40141_at | 743 | N40141 | JM27 proteinXp11.23 | 10.9 | 0.013756347 |
| | RC_R25410_at | 814 | R25410 | ESTs | 7.7 | 0.01851753 |
| | L49169_at | 649 | L49169 | FBJ murine osteosarcoma viral oncogene homolog B19q13.3 | 7.4 | 0.041523744 |
| | RC_AA279760_at | 193 | AA279760 | ESTs | 7.0 | 0.024411468 |
| | RC_T90889_at | 927 | T90889 | ESTs | 6.5 | 0.015666863 |
| | U62015_at | 978 | U62015 | insulin-like growth factor binding protein 101p22-p31 | 6.0 | 0.002843661 |
| | RC_AA188981_at | 112 | AA188981 | highly expressed in cancer, rich in leucine heptad repeats | 5.9 | 0.002280479 |
| | D83018_at | 513 | D83018 | nel (chicken)-like212q13.11-q13.12 | 5.6 | 0.000570952 |
| | RC_H64493_f_at | 590 | H64493 | immunoglobulin gamma 3 (Gm marker)14q32.33 | 5.6 | 0.01109802 |
| | X52541_at | 1064 | X52541 | early growth response 15q31.1 | 5.2 | 0.002428259 |
| | M57466_s_at | 690 | M57466 | major histocompatibility complex, class II, DP beta 16p21.3 | 5.1 | 0.002137399 |
| | J03507_at | 621 | J03507 | complement component 75p13 | 4.9 | 1.36616E-05 |
| | RC_N30198_at | 733 | N30198 | ESTs | 4.8 | 0.003366461 |
| | RC_T78398_at | 913 | T78398 | EST | 4.8 | 0.033293747 |
| | RC_H17550_at | 559 | H17550 | ESTs | 4.7 | 0.047828622 |
| | RC_T67053_f_at | 909 | T67053 | immumoglobulin lambda gene cluster22q11.1-q11.2 | 4.5 | 0.045107075 |
| | RC_AA598982_s_at | 429 | AA598982 | trophininXp11.22-p11.21 | 4.3 | 0.000902336 |
| | RC_AA256268_at | 175 | AA256268 | ESTs | 4.2 | 0.001506239 |
| | HG3543-HT3739_at | 675 | M29645 | insulin-like growth factor 2 (somatomedin A)11p15.5 | 4.1 | 0.017253126 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | RC_N91971_f_at | 791 | N91971 | retinol-binding protein 1, cellular3q23 | 4.1 | 0.02528773 |
| | RC_AA479286_at | 403 | AA479286 | ESTs | 4.0 | 0.028009544 |
| | M62831_at | 695 | M62831 | immediate early protein19 | 4.0 | 0.000484086 |
| | RC_F02992_at | 526 | F02992 | ESTs, Weakly similar to unknown [*M. musculus*] | 3.9 | 0.031845412 |
| | RC_H86112_f_at | 600 | H86112 | KIAA0471 geneproduct1q24-q25 | 3.8 | 0.004155259 |
| | RC_AA436616_at | 335 | AA436616 | ESTs | 3.8 | 0.017156387 |
| | RC_T62857_at | 903 | T62857 | ESTs | 3.7 | 0.000301735 |
| | RC_AA281345_f_at | 201 | AA281345 | immediate early protein19 | 3.6 | 0.001679723 |
| | U21128_at | 953 | U21128 | lumican12q21.3-q22 | 3.6 | 2.19529E−05 |
| | U30521_at | 960 | U30521 | P311 protein | 3.6 | 0.001150397 |
| | RC_N58172_at | 757 | N58172 | ESTs | 3.5 | 0.043092144 |
| | RC_T03229_f_at | 874 | T03229 | EST | 3.5 | 0.031101935 |
| Up-regulated | RC_AA410383_at | 277 | AA410383 | B-cell-homing chemokine (ligand for Burkitt's lymphoma receptor-1)4q21 | 22.5 | 0.025197485 |
| | X06700_s_at | 1049 | X06700 | collagen, type III, alpha 1 (Ehlers-Danlos syndrome type IV, autosomal dominant)2q31 | 3.5 | 0.008472599 |
| | RC_Z39904_at | 1111 | Z39904 | *Homo sapiens* clone 23555 mRNA sequence | 3.4 | 0.002949046 |
| | RC_T23622_at | 886 | T23622 | ESTs | 3.4 | 0.002174281 |
| | J00231_f_at | 617 | J00231 | immunoglobulin gamma 3 (Gm marker)14q32.33 | 3.4 | 0.009322568 |
| | RC_AA028092_s_at | 17 | AA028092 | transcription factor 216pter-qter | 3.4 | 3.13963E−06 |
| | RC_AA252528_at | 170 | AA252528 | ESTs | 3.4 | 0.000225707 |
| | L33799_at | 645 | L33799 | procollagen C-endopeptidase enhancer7q22 | 3.3 | 0.018469201 |
| | RC_F09748_s_at | 537 | F09748 | *Homo sapiens* mRNA; cDNA DKFZp586K1220 (from clone DKFZp586K1220) | 3.2 | 0.02728166 |
| | RC_T64223_s_at | 907 | T64223 | carboxypeptidase A3 (mast cell)3q21 q25 | 3.2 | 0.027915742 |
| | RC_AA402903_f_at | 263 | AA402903 | immunoglobulin gamma 3 (Gm marker)14q32.33 | 3.2 | 0.044721116 |
| | RC_F13763_at | 542 | F13763 | ESTs | 3.1 | 0.000503701 |
| | RC_AA488432_at | 412 | AA488432 | phosphoserine phosphatase7p21-p15 | 3.1 | 0.020997503 |
| | RC_AA486072_i_at | 410 | AA486072 | small inducible cytokine A5 (RANTES)17q11.2-q12 | 3.1 | 0.025877597 |
| | RC_N22006_s_at | 719 | N22006 | EST | 3.1 | 0.00148561 |
| | RC_AA257093_r_at | 178 | AA257093 | T-cell receptor, beta cluster7q35 | 3.1 | 1.71945E−07 |
| | RC_AA609943_at | 449 | AA609943 | ESTs | 3.0 | 0.029360518 |
| | RC_T23490_s_at | 885 | T23490 | ESTs | 3.0 | 0.008741411 |
| | D13628_at | 476 | D13628 | angiopoietin 18q22.3-q23 | 2.9 | 0.006228419 |
| | M73720_at | 702 | M73720 | carboxypeptidase A3 (mast ceLl)3q21 q25 | 2.9 | 0.006585391 |
| | Z74616_s_at | 1123 | Z74616 | collagen, type I, alpha 27q22.1 | 2.8 | 0.008750622 |
| | AA082546_at | 54 | AA082546 | ESTs | 2.8 | 0.019771126 |
| | RC_AA284920_at | 213 | AA284920 | ESTs | 2.7 | 0.019738239 |
| | RC_AA599365_at | 434 | AA599365 | decorin12q23 | 2.7 | 0.001295936 |
| | X57025_at | 1066 | X57025 | insulin-like growth factor 1 (somatomedin C)12q22-q23 | 2.7 | 0.022341194 |
| | X51345_at | 1062 | X51345 | jun B proto-oncogene19p13.2 | 2.7 | 0.036487159 |
| | RC_N67876_s_at | 773 | N67876 | insulin-like growth factor 1 (somatomedin C)12q22-q23 | 2.7 | 0.035216134 |
| | RC_AA609504_at | 444 | AA609504 | KIAA0405 gene product | 2.7 | 0.020881055 |
| | RC_N69207_at | 776 | N69207 | ESTs, Moderately similar to !!!! ALU SUBFAMILY SB2 WARNING ENTRY !!!! [*H. sapiens*] | 2.6 | 0.041315387 |
| | M87789_s_at | 704 | M87789 | immunoglobulin gamma 3 (Gm marker)14q32.33 | 2.6 | 0.038916248 |
| | HG3510-HT3704_at | 1055 | X12795 | nuclear receptor subfamily 2, group F, member 15q14 | 2.6 | 0.016151338 |
| | RC_T64211_at | 906 | T64211 | ESTs, Weakly similar to pancortin-1 8 *M. musculus*] | 2.6 | 0.006233291 |
| | U90552_s_at | 988 | U90552 | butyrophilin, subfamily 3, member A16p23 | 2.6 | 0.004564282 |
| | M34516_r_at | 684 | M34516 | immunoglobulin lambda-like polypeptide 322q11.2 | 2.6 | 0.049767038 |
| Up-regulated | RC_AA410383_at | 277 | AA410383 | B-cell-homing chemokine (ligand for Burkitt's lymphoma receptor-1)4q21 | 22.5 | 0.025197485 |
| | RC_T23468_at | 884 | T23468 | ESTs | 2.5 | 0.00250737 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | RC_AA173223_at | 108 | AA173223 | ESTs, Weakly similar to !!!! ALU SUBFAMILY SQ WARNING ENTRY !!!! [*H. sapiens*] | 2.5 | 0.007080285 |
| | RC_T49061_at | 894 | T49061 | ESTs | 2.5 | 0.039642391 |
| | RC_AA234095_at | 144 | AA234095 | ESTs | 2.5 | 0.003152859 |
| | RC_F01920_s_at | 520 | F01920 | pre-B-cell leukemia transcription factor 39q33-q34 | 2.5 | 0.002088945 |
| | RC_N91461_at | 789 | N91461 | ESTs | 2.4 | 0.01015467 |
| | RC_N67575_s_at | 771 | N67575 | osteoglycin (osteoinductive factor) | 2.4 | 0.004044061 |
| | RC_AA151210_at | 89 | AA151210 | ESTs | 2.4 | 0.011476541 |
| | AA156897_s_at | 97 | AA156897 | *Homo sapiens* mRNA; cDNA DKFZp564I1922 (from clone DKFZp564I1922) | 2.4 | 0.033974981 |
| | W73859_at | 1028 | W73859 | transcription factor 216pter-qter | 2.4 | 0.024640626 |
| | RC_H68097_at | 592 | H68097 | EST | 2.4 | 0.04870874 |
| | RC_AA436618_at | 336 | AA436618 | ESTs | 2.4 | 0.02483165 |
| | M33493_s_at | 680 | M33493 | tryptase, beta (tryptase II)16p13.3 | 2.4 | 0.02689938 |
| | AB002340_at | 461 | AB002340 | KIAA0342 gene product | 2.3 | 0.000748796 |
| | RC_AA446661_at | 347 | AA446661 | ESTs | 2.3 | 0.011980248 |
| | RC_AA084138_at | 55 | AA084138 | ESTs | 2.3 | 1.16025E−05 |
| | RC_N59866_at | 761 | N59866 | ESTs, Weakly similar to putative p150 [*H. sapiens*] | 2.3 | 0.002042263 |
| | RC_R42424_at | 832 | R42424 | ESTs | 2.3 | 0.003173074 |
| | RC_N39415_at | 742 | N39415 | osteoglycin (osteoinductive factor) | 2.3 | 0.001310764 |
| | J03464_s_at | 620 | J03464 | collagen, type I, alpha 27q22.1 | 2.3 | 0.006791534 |
| | RC_AA205376_at | 121 | AA205376 | KIAA0471 gene product1q24-q25 | 2.3 | 0.023123837 |
| | RC_H95960_at | 606 | H95960 | secreted protein, acidic, cysteine-rich (osteonectin)5q31.3-q32 | 2.3 | 0.008509182 |
| | D28137_at | 484 | D28137 | bone marrow stromal cell antigen 219p13.2 | 2.3 | 0.031127266 |
| | RC_N79778_at | 784 | N79778 | extracellular matrix protein 2, female organ and adipocyte specific9q22.3 | 2.3 | 0.045073744 |
| | RC_N98485_s_at | 800 | N98485 | forkhead (Drosophila)-like 66p25.3 | 2.3 | 0.033372862 |
| | M98539_at | 715 | M98539 | prostaglandin D2 synthase (21 kD, brain)9q34.2-q34.3 | 2.2 | 0.005442674 |
| | RC_AA205724_at | 123 | AA205724 | ESTs | 2.2 | 0.006183612 |
| | U85625_at | 986 | U85625 | *Homo sapiens* ribonuclease 6 precursor, mRNA, complete cds. | 2.2 | 0.001245066 |
| | RC_R37588_s_at | 821 | R37588 | RAB2, member RAS oncogene family-like6p21.3 | 2.2 | 0.00219386 |
| | RC_AA046426_at | 35 | AA046426 | Cdc42 effector protein 3 | 2.2 | 0.005788723 |
| | RC_AA256294_at | 176 | AA256294 | ESTs | 2.2 | 0.002425605 |
| 2979241 | RC_AA599120_at | 431 | AA599120 | SWI/SNF related, matrix associated, actin dependent regulator of chromatin, subfamily e, member 1 | 2.2 | 0.04 |
| | RC_W60186_at | 1018 | W60186 | ESTs | 2.2 | 0.028494835 |
| | RC_AA599216_at | 432 | AA599216 | collapsin response mediator protein 14p16.1-p15 | 2.2 | 0.040523744 |
| | RC_AA450324_at | 360 | AA450324 | ESTs | 2.1 | 0.009094567 |
| | M31994_at | 678 | M31994 | *Homo sapiens* aldehyde dehydrogenase (ALDH1) gene | 2.1 | 0.001561218 |
| Up-regulated | RC_AA410383_at | 277 | AA410383 | B-cell-homing chemokine (ligand for Burkitt's lymphoma receptor-1)4q21 | 22.5 | 0.025197485 |
| | RC_AA402930_at | 264 | AA402930 | ESTs | 2.1 | 0.000114627 |
| | M91029_cds2_at | 706 | M91029 | Human AMP deaminase isoform L (AMPD2) mRNA, exons 6–18, partial cds | 2.1 | 0.02494373 |
| | RC_AA450114_at | 358 | AA450114 | ESTs, Weakly similar to 17beta-hydroxysteroid dehydrogenase [*H. sapiens*] | 2.1 | 4.87556E−06 |
| | D62584_at | 501 | D62584 | osteoglycin (osteoinductive factor) | 2.1 | 0.000157116 |
| | RC_AA621634_at | 457 | AA621634 | ESTs | 2.1 | 0.02297009 |
| | RC_AA312946_s_at | 228 | AA312946 | ESTs | 2.1 | 3.51075E−05 |
| | X07438_s_at | 1054 | X07438 | Human DNA for cellular retinol binding protein (CRBP) | 2.1 | 0.039015947 |
| | RC_N53447_at | 751 | N53447 | integral membrane protein 2CXq21.1-21.2 | 2.1 | 0.009032297 |
| | RC_AA281591_at | 202 | AA281591 | *Homo sapiens* mRNA; cDNA DKFZp586B211 (from clone DKFZp586B211) | 2.0 | 0.016660714 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | RC_R71395_at | 854 | R71395 | ESTs, Moderately similar to alternatively spliced product using exon 13A [*H. sapiens*] | 2.0 | 0.046231847 |
| | RC_T53590_s_at | 899 | T53590 | cytochrome P450, subfamily XIA (cholesterol side chain cleavage)15q23-q24 | 2.0 | 0.00282074 |
| | RC_AA293489_at | 224 | AA293489 | KIAA0638 protein | 2.0 | 0.006966532 |
| | RC_AA447707_s_at | 351 | AA447707 | KIAA1055 protein | 2.0 | 0.001248537 |
| | RC_AA235618_f_at | 149 | AA235618 | ESTs | 2.0 | 0.012481746 |
| | RC_N68350_at | 775 | N68350 | ESTs | 2.0 | 0.035156598 |
| | RC_H81379_s_at | 596 | H81379 | ESTs, Moderately similar to KIAA0438 [*H. sapiens*] | 2.0 | 0.01148429 |
| | RC_D51060_s_at | 495 | D51060 | Jun activation domain binding protein1p32-p31 | 2.0 | 0.016668951 |
| | U72649_at | 983 | U72649 | B-cell translocation gene 2 (pheochromacytoma cell-3)1q32 | 2.0 | 0.020660388 |
| | RC_AA287389_at | 216 | AA287389 | ESTs | 2.0 | 0.002741873 |
| | RC_AA621367_at | 456 | AA621367 | ESTs | 2.0 | 0.004871903 |
| | J03040_at | 619 | J03040 | secreted protein, acidic, cysteine-rich (osteonectin)5q31.3-q32 | 2.0 | 0.006303994 |
| | RC_AA291676_s_at | 219 | AA291676 | non-metastatic cells 5, protein expressed in (nucleoside-diphosphate kinase)5q23-q31 | 2.0 | 0.027480479 |
| | RC_N63536_at | 763 | N63536 | ESTs | 2.0 | 0.000634305 |
| | RC_AA411952_at | 282 | AA411952 | UDP-Gal:betaGlcNAc beta 1,3-galactosyltransferase, polypeptide 33q25 | 2.0 | 0.011858934 |
| | RC_AA252802_s_at | 171 | AA252802 | Human mRNA for TI-227H | 2.0 | 0.041027635 |
| | RC_AA382275_at | 244 | AA382275 | ESTs | 2.0 | 0.00087437 |
| | AA093923_at | 63 | AA093923 | tissue inhibitor of metalloproteinase 217q25 | 2.0 | 0.046200886 |
| | M11313_s_at | 654 | M11313 | alpha-2-macroglobulin12p13.3-p12.3 | 2.0 | 0.013660595 |
| | RC_AA398280_at | 248 | AA398280 | ESTs | 2.0 | 0.044320644 |
| | RC_N51529_at | 747 | N51529 | ESTs | 2.0 | 0.006276979 |
| | H49440_at | 578 | H49440 | nudix (nucleoside diphosphate linked moiety X)-type motif 36p21.2 | 2.0 | 0.013879331 |
| Up-regulated | RC_AA410383_at | 277 | AA410383 | B-cell-homing chemokine (ligand for Burkitt's lymphoma receptor-1)4q21 | 22.5 | 0.025197485 |
| | RC_T33263_s_at | 890 | T33263 | KIAA0320 protein | 2.0 | 0.009994615 |
| | RC_T89160_r_at | 921 | T89160 | ESTs | 2.0 | 0.005289266 |
| | RC_W56792_at | 1016 | W56792 | ESTs, Weakly similar to serine/threonine protein kinase TAO1 8 *R. norvegicus*] | 2.0 | 0.026130523 |
| | RC_R60056_at | 849 | R60056 | ESTs, Moderately similar to alternatively spliced product using exon 13A [*H. sapiens*] | 2.0 | 0.001585076 |
| Down-regulated | RC_AA398908_at | 251 | AA398908 | Human Chromosome 16 BAC clone CIT987SK-A-61E3 | −21.7 | 0.007918174 |
| | RC_AA460914_at | 380 | AA460914 | ESTs | −15.8 | 0.013659536 |
| | RC_T40895_at | 892 | T40895 | ESTs | −12.6 | 0.002430219 |
| | RC_R71792_s_at | 855 | R71792 | ESTs, Moderately similar to FAT-SPECIFIC PROTEIN FSP27 8 *M. musculus*] | −9.8 | 0.01438632 |
| | RC_N80129_i_at | 785 | N80129 | metallothionein 1L16q13 | −8.7 | 0.002816872 |
| | X66141_at | 1078 | X66141 | myosin, light polypeptide 2, regulatory, cardiac, slow12q23-q24.3 | −8.0 | 0.03928942 |
| | AA234634_f_at | 145 | AA234634 | CCAAT/enhancer binding protein (C/EBP), delta8p11.2-p11.1 | −7.4 | 0.000589696 |
| | U78294_at | 985 | U78294 | arachidonate 15-lipoxygenase, second type | −6.8 | 0.017271608 |
| | RC_AA457566_at | 375 | AA457566 | ESTs | −6.6 | 0.029644622 |
| | X93036_at | 1093 | X93036 | phospholemman-like, expressed in breast tumors, 8kD | −6.2 | 0.011323909 |
| | X57129_at | 1067 | X57129 | H1 histone family, member 26p21.3 | −6.1 | 0.004161922 |
| | HG1067-HT1067_r_at | 671 | M22406 | Human intestinal mucin mRNA, partial cds, clone SMUC 42 | −5.8 | 0.007202185 |
| | X65614_at | 1076 | X65614 | S100 calcium-binding protein P4p16 | −5.8 | 0.006892572 |
| | RC_AA609006_at | 440 | AA609006 | ESTs | −5.7 | 0.015701354 |
| | J03910_rna1_at | 622 | J03910 | metallothionein 1G16q13 | −5.7 | 0.003506953 |
| | RC_H94471_at | 604 | H94471 | occludin5q13.1 | −5.6 | 0.025014274 |
| | AB000584_at | 459 | AB000584 | prostate differentiation factor | −5.4 | 0.003235425 |
| | RC_W88568_at | 1035 | W88568 | glycogenin 2Xp22.3 | −5.1 | 0.048573115 |

TABLE 1-continued

Normal1-Normal2 vs BPH-With Symptoms

|  | Affymetrix element | SEQ ID NO: | Genbank ID | Genbank Name | Fold-change N1-N2 vs With | p-value N1-N2 vs With |
|---|---|---|---|---|---|---|
|  | V00594_at | 992 | V00594 | metallothionein 2A16q13 | −5.0 | 0.000721258 |
|  | RC_T73433_s_at | 912 | T73433 | angiotensinogen1q41-qter | −4.9 | 0.012700144 |
|  | RC_N94303_at | 797 | N94303 | ESTs | −4.5 | 4.88059E−05 |
|  | RC_AA419011_at | 296 | AA419011 | Homo sapiens mRNA; cDNA DKFZp586D0823 (from clone DKFZp586D0823) | −4.1 | 0.013801595 |
|  | RC_N32748_at | 736 | N32748 | ESTs | −4.1 | 0.018749207 |
|  | RC_AA053424_at | 40 | AA053424 | ESTs, Weakly similar to mucin Muc3 [R. norvegicus] | −4.0 | 0.001235197 |
|  | RC_AA599331_at | 433 | AA599331 | ESTs | −4.0 | 0.005480655 |
|  | M99487_at | 716 | M99487 | folate hydrolase (prostate-specific membrane antigen) 111p11.2 | −3.9 | 0.013268152 |
|  | RC_F02245_at | 522 | F02245 | monoamine oxidase AXp11.4-p11.3 | −3.8 | 0.002950391 |
|  | X76717_at | 1087 | X76717 | metallothionein 1L16q13 | −3.7 | 0.000868707 |
| Up-regulated | RC_AA410383_at | 277 | AA410383 | B-cell-homing chemokine (ligand for Burkitt's lymphoma receptor-1)4q21 | 22.5 | 0.025197485 |
|  | X64177_f_at | 1075 | X64177 | metallothionein 1H16q13 | −3.7 | 0.002089771 |
|  | RC_AA599522_r_at | 437 | AA599522 | squamous cell carcinoma antigen recognised by T cells | −3.6 | 0.012643918 |
|  | L77701_at | 651 | L77701 | human homolog of yeast mitochondrial copper recruitment gene | −3.6 | 0.003341007 |
|  | RC_D11824_at | 474 | D11824 | ESTs, Moderately similar to weak similarity to Arabidopsis thaliana ubiquitin-like protein 8 [C. elegans] | −3.6 | 0.000803294 |
|  | RC_AA410311_at | 275 | AA410311 | ESTs | −3.5 | 0.001234064 |
|  | RC_AA457235_at | 373 | AA457235 | ESTs | −3.5 | 0.012177965 |
|  | RC_N93798_at | 796 | N93798 | protein tyrosine phosphatase type IVA, member 3 | −3.5 | 0.007340453 |
|  | RC_AA416762_s_at | 291 | AA416762 | nuclear receptor subfamily 1, group H, member 219q13.3-19q13.3 | −3.5 | 0.010404304 |
|  | RC_F03969_at | 528 | F03969 | ESTs, Weakly similar to tumorous imaginal discs protein Tid56 homolog [H. sapiens] | −3.5 | 0.011826812 |
|  | RC_AA045487_at | 31 | AA045487 | ESTs | −3.4 | 0.025187615 |
|  | RC_Z38744_at | 1108 | Z38744 | putative gene product13 | −3.4 | 2.30674E−05 |
|  | RC_N92502_s_at | 794 | N92502 | ESTs, Moderately similar to HERV-E integrase [H. sapiens] | −3.4 | 0.02301359 |
|  | RC_R91484_at | 863 | R91484 | ESTs | −3.4 | 8.2306E−05 |
|  | RC_AA165313_at | 104 | AA165313 | ESTs | −3.3 | 0.028364404 |
|  | RC_AA182030_at | 110 | AA182030 | ESTs | −3.3 | 0.019770486 |
|  | RC_T94447_s_at | 928 | T94447 | ESTs, Moderately similar to (define not available 4335935) [M. musculus] | −3.3 | 0.001427294 |
|  | RC_W20486_f_at | 995 | W20486 | ESTs | −3.3 | 0.002892697 |
|  | RC_R16983_at | 811 | R16983 | ESTs | −3.2 | 0.000912559 |
|  | RC_AA504805_s_at | 424 | AA504805 | interferon stimulated gene (20kD)15q26 | −3.2 | 0.003905701 |
|  | RC_T90190_s_at | 925 | T90190 | H1 histone family, member 26p21.3 | −3.2 | 0.020618793 |
|  | RC_AA135870_at | 79 | AA135870 | ESTs | −3.1 | 0.04609197 |
|  | RC_H99035_at | 612 | H99035 | ESTs | −3.1 | 0.000191451 |
|  | RC_R28370_at | 815 | R28370 | ESTs | −3.1 | 0.024606319 |
|  | RC_T40995_f_at | 893 | T40995 | alcohol dehydrogenase 3 (class I), gamma polypeptide4q21-q23 | −3.1 | 0.024064044 |
|  | MIP1-B_at | 1124 | M35590 | karyopherin (importin) beta 2 | −3.1 | 0.005882353 |
|  | RC_AA447522_at | 349 | AA447522 | ESTs, Highly similar to differentially expressed in Fanconi anemia [H. sapiens] | −3.1 | 0.003518059 |
|  | RC_AA461453_at | 382 | AA461453 | ESTs, Moderately similar to Cab45a [M. musculus] | −3.0 | 0.021949087 |
|  | AA429539_f_at | 318 | AA429539 | ESTs | −3.0 | 0.017623102 |
|  | RC_AA476944_at | 394 | AA476944 | ESTs | −3.0 | 0.019974254 |
|  | RC_N80129_f_at | 785 | N80129 | metallothionein 1L16q13 | −3.0 | 0.000219038 |
|  | RC_N26904_at | 731 | N26904 | ESTs, Weakly similar to FK506/rapamycin-binding protein FKBP13 precursor [H. sapiens] | −2.9 | 0.006305062 |
|  | RC_AA505136_at | 426 | AA505136 | ESTs | −2.9 | 0.005400284 |
|  | AA455001_s_at | 368 | AA455001 | ESTs | −2.9 | 2.1534E−05 |
|  | RC_W70131_at | 1024 | W70131 | ESTs | −2.9 | 0.005764635 |
| Up-regulated | RC_AA410383_at | 277 | AA410383 | B-cell-homing chemokine (ligand for Burkitt's lymphoma receptor-1)4q21 | 22.5 | 0.025197485 |
|  | RC_AA043349_at | 27 | AA043349 | ESTs | −2.9 | 0.016983419 |
|  | U02020_at | 936 | U02020 | pre-B-cell colony-enhancing factor | −2.9 | 0.003324497 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | U52969_at | 970 | U52969 | Purkinje cell protein 421q22.2-q22.3 | −2.8 | 0.00078638 |
| | RC_H22453_at | 564 | H22453 | ESTs | −2.8 | 0.000410695 |
| | RC_N22620_at | 722 | N22620 | ESTs | −2.8 | 0.005507089 |
| | RC_N64683_at | 764 | N64683 | ESTs | −2.8 | 0.00378977 |
| | RC_N24761_at | 725 | N24761 | ESTs | −2.8 | 0.004837185 |
| | RC_AA464728_s_at | 388 | AA464728 | ESTs | −2.8 | 0.004669897 |
| | RC_H83380_at | 598 | H83380 | ESTs | −2.7 | 0.016543793 |
| | M30894_at | 676 | M30894 | T-cell receptor, gamma cluster7p15-p14 | −2.7 | 0.034153167 |
| | RC_H81070_f_at | 595 | H81070 | Human metallothionein (MT)I-F gene | −2.7 | 0.022654931 |
| | J00073_at | 615 | J00073 | actin, alpha, cardiac muscle15q11-qter | −2.7 | 0.029724167 |
| | RC_H05084_at | 547 | H05084 | ESTs, Weakly similar to ORF YDL055c [*S. cerevisiae*] | −2.7 | 0.016965435 |
| | AA045870_at | 34 | AA045870 | *Homo sapiens* mRNA; cDNA DKFZp564A072 (from clone DKFZp564A072) | −2.7 | 0.005480167 |
| | RC_T68873_f_at | 911 | T68873 | metallothionein 1L16q13 | −2.7 | 0.001140431 |
| | RC_N72253_at | 778 | N72253 | ESTs | −2.7 | 0.001832591 |
| | RC_AA447977_s_at | 352 | AA447977 | *Homo sapiens* mRNA; cDNA DKFZp564A072 (from clone DKFZp564A072) | −2.7 | 0.001255304 |
| | RC_H18947_at | 561 | H18947 | ESTs | −2.7 | 0.00193501 |
| | RC_H77597_f_at | 594 | H77597 | metallothionein 1H16q13 | −2.7 | 0.001560766 |
| | RC_H94475_s_at | 605 | H94475 | alpha-2-plasmin inhibitor17pter-p12 | −2.6 | 0.01435663 |
| | RC_AA025370_at | 15 | AA025370 | KIAA0872 protein | −2.6 | 0.013924142 |
| | RC_AA443114_at | 343 | AA443114 | ESTs, Moderately similar to PIM-1 PROTO-ONCOGENE SERINE/THREONINE-PROTEIN KINASE [*M. musculus*] | −2.6 | 0.000703574 |
| | RC_F09684_at | 535 | F09684 | ESTs | −2.6 | 0.000107291 |
| | RC_AA031360_s_at | 20 | AA031360 | ESTs | −2.6 | 0.047293081 |
| | RC_AA416685_at | 290 | AA416685 | UNC13 (*C. elegans*)-like9p11-p12 | −2.6 | 0.023296279 |
| | D29805_at | 487 | D9805 | UDP-Gal:betaGlcNAc beta 1,4-galactosyltransferase, polypeptide 19p13 | −2.6 | 2.3562E−05 |
| | RC_H58873_s_at | 583 | H58873 | solute carrier family 2 (facilitated glucose transporter), member 11p35-p31.3 | −2.5 | 0.000710917 |
| | M10942_at | 652 | M10942 | metallothionein 1E (functional)16q13 | −2.5 | 0.017370635 |
| | RC_T03593_at | 875 | T03593 | ESTs | −2.5 | 0.006239127 |
| | RC_N95495_at | 799 | N95495 | small inducible cytokine A5 (RANTES)17q11.2-q12 | −2.5 | 0.002392984 |
| | RC_AA017063_r_at | 8 | AA017063 | ESTs, Highly similar to Miz-1 protein [*H. sapiens*] | −2.5 | 0.048093776 |
| | RC_R00144_at | 801 | R00144 | ESTs | −2.5 | 0.018222161 |
| | RC_AA599522_f_at | 437 | AA599522 | squamous cell carcinoma antigen recognised by T cells | −2.5 | 0.03100833 |
| Up-regulated | RC_AA410383_at | 277 | AA410383 | B-cell-homing chemokine (ligand for Burkitt's lymphoma receptor-1)4q21 | 22.5 | 0.025197485 |
| | RC_AA219552_s_at | 134 | AA219552 | ESTs | −2.5 | 0.043156485 |
| | RC_AA447537_at | 350 | AA447537 | ESTs, Moderately similar to (define not available 5360237) [*M. musculus*] | −2.5 | 0.031129269 |
| | RC_AA070752_s_at | 51 | AA070752 | insulin receptor substrate 12q36 | −2.5 | 0.002895462 |
| | RC_R02003_r_at | 804 | R02003 | ESTs, Weakly similar to cappuccino [*D. melanogaster*] | −2.4 | 0.002315115 |
| | L13698_at | 638 | L13698 | growth arrest-specific 19q21.3-q22.1 | −2.4 | 0.013393145 |
| | RC_AA432292_at | 325 | AA432292 | ESTs, Moderately similar to B cell growth factor [*H. sapiens*] | −2.4 | 0.000956642 |
| | RC_H99648_s_at | 613 | H99648 | DNA segment, single copy probe LNS-CAI/LNS-CAII (deleted in polyposis5q22-q23 | −2.4 | 0.009066307 |
| | RC_AA131919_at | 75 | AA131919 | putative type II membrane protein | −2.4 | 0.000187872 |
| | RC_AA621695_at | 458 | AA621695 | ESTs | −2.4 | 0.008761556 |
| | RC_AA598695_at | 427 | AA598695 | ESTs, Weakly similar to !!!! ALU SUBFAMILY SX WARNING ENTRY !!!! [*H. sapiens*] | −2.4 | 0.000549977 |
| | RC_AA430388_at | 321 | AA430388 | ESTs, Moderately similar to !!!! ALU SUBFAMILY SQ WARNING ENTRY !!!! [*H. sapiens*] | −2.4 | 0.000135176 |
| | M24069_at | 672 | M24069 | cold shock domain protein A12p13.1 | −2.4 | 0.015890231 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | RC_AA434108_at | 327 | AA434108 | *Homo sapiens* heat shock protein hsp40-3 mRNA, complete cds | −2.4 | 0.013182623 |
| | RC_AA405488_at | 268 | AA405488 | ESTs | −2.3 | 0.015044159 |
| | RC_AA419546_at | 297 | AA419546 | ESTs | −2.3 | 0.030432017 |
| | RC_W38197_at | | W38197 | EST | −2.3 | 0.013006462 |
| | RC_R38709_s_at | 824 | R38709 | superoxide dismutase 2, mitochondrial6q25.3 | −2.3 | 0.03567491 |
| | RC_AA121142_at | 69 | AA121142 | ESTs, Moderately similar to copper transport protein HAH1 [*H. sapiens*] | −2.3 | 0.043639016 |
| | RC_N26801_at | 730 | N26801 | ESTs | −2.3 | 0.000580867 |
| | RC_N75960_at | 781 | N75960 | ESTs | −2.3 | 0.01244791 |
| | RC_R36969_at | 820 | R36969 | ESTs | −2.3 | 0.019129486 |
| | AA046840_at | 36 | AA046840 | CCAAT/enhancer binding protein (C/EBP), delta8p11.2-p11.1 | −2.3 | 0.002504544 |
| | RC_R46074_at | 840 | R46074 | transforming, acidic coiled-coil containing protein 210q26 | −2.3 | 0.003462273 |
| | X06956_at | 1051 | X06956 | tubulin, alpha 1 (testis specific)2q | −2.3 | 0.015437809 |
| | RC_H84761_s_at | 599 | H84761 | glutathione peroxidase 13p21.3 | −2.2 | 0.000365528 |
| | RC_W52065_f_at | 1012 | W52065 | KIAA0539 gene product | −2.2 | 0.016497348 |
| | RC_AA279757_at | 192 | AA279757 | ESTs, Weakly similar to (define not available 4481810) [D. melanogaster] | −2.2 | 0.003272622 |
| | RC_H16676_s_at | 556 | H16676 | ESTs, Weakly similar to (define not available 5107634) 8 R. norvegicus] | −2.2 | 8.86866E−05 |
| | RC_AA255480_at | 173 | AA255480 | ESTs | −2.2 | 0.009359024 |
| | RC_R96924_s_at | 866 | R96924 | ESTs | −2.2 | 0.000201685 |
| | RC_AA342337_at | 231 | AA342337 | ESTs, Moderately similar to !!!! ALU SUBFAMILY SQ WARNING ENTRY !!!! [*H. sapiens*] | −2.2 | 0.024999347 |
| | RC_AA004699_at | 1 | AA004699 | putative translation initiation factor | −2.2 | 0.022298405 |
| Up-regulated | RC_AA410383_at | 277 | AA410383 | B-cell-homing chemokine (ligand for Burkitt's lymphoma receptor-1)4q21 | 22.5 | 0.025197485 |
| | RC_AA401965_at | 258 | AA401965 | tumor suppressor deleted in oral cancer-related 111q13 | −2.2 | 0.006294885 |
| | RC_F02470_at | 524 | F02470 | *Homo sapiens* clone 24796 mRNA sequence | −2.2 | 0.022313149 |
| | X76180_at | 1086 | X76180 | sodium channel, nonvoltage-gated 1 alpha 12p13 | −2.2 | 0.023078001 |
| | RC_R49138_s_at | 841 | R49138 | coatomer protein complex, subunit epsilon | −2.2 | 0.020401578 |
| | RC_D80237_s_at | 506 | D80237 | actin related protein 2/3 complex, subunit 4 (20 kD) | −2.2 | 0.022022634 |
| | RC_AA402224_at | 260 | AA402224 | growth arrest and DNA-damage-inducible, gamma9q22.1-q22.2 | −2.2 | 0.014983528 |
| | RC_AA281599_at | 203 | AA281599 | *Homo sapiens* mRNA for for histone H2B, clone pjG4-5-14 | −2.2 | 0.029567009 |
| | RC_N78630_at | 782 | N78630 | KIAA0870 protein | −2.2 | 0.006668895 |
| | X85785_rna1_at | 1091 | X85785 | Duffy blood group1q21-q22 | −2.2 | 0.018706507 |
| | RC_AA412063_at | 285 | AA412063 | ESTs | −2.2 | 0.000686563 |
| | RC_AA022886_at | 14 | AA022886 | ESTs, Weakly similar to phosphatidylinositol transfer protein [*H. sapiens*] | −2.2 | 0.000777067 |
| | RC_N24899_at | 726 | N24899 | ESTs | −2.2 | 0.030610964 |
| | RC_AA101767_at | 66 | AA101767 | ESTs | −2.2 | 0.009040467 |
| | RC_AA045503_at | 32 | AA045503 | ESTs, Weakly similar to *Homo sapiens* p20 protein [*H. sapiens*] | −2.2 | 0.021950966 |
| | RC_F10078_at | 538 | F10078 | ESTs | −2.1 | 0.040699115 |
| | RC_H02308_at | 545 | H02308 | ESTs | −2.1 | 0.036730715 |
| | RC_AA284153_at | 210 | AA284153 | ESTs | −2.1 | 0.021270233 |
| | RC_AA453433_at | 363 | AA453433 | HLA-B associated transcript-16p21.3 | −2.1 | 0.013366375 |
| | RC_AA403159_at | 265 | AA403159 | *Homo sapiens* Ste-20 related kinase SPAK mRNA, complete cds | −2.1 | 0.025212073 |
| | RC_T17428_s_at | 883 | T17428 | *Homo sapiens* clone 23836 mRNA sequence | −2.1 | 0.044754602 |
| | RC_W92449_at | 1037 | W92449 | ESTs, Highly similar to (defline not available 4587714) [*H. sapiens*] | −2.1 | 0.019386585 |
| | RC_AA609312_at | 443 | AA609312 | ESTs | −2.1 | 0.003204911 |
| | D28589_at | 486 | D28589 | Human mRNA (KIAA00167), partial sequence | −2.1 | 0.000408478 |
| | RC_AA232508_at | 139 | AA232508 | ESTs, Highly similar to (defline not available 4929647) [*H. sapiens*] | −2.1 | 0.004626663 |

TABLE 1-continued

Normal1-Normal2 vs BPH-With Symptoms

| | Affymetrix element | SEQ ID NO: | Genbank ID | Genbank Name | Fold-change N1-N2 vs With | p-value N1-N2 vs With |
|---|---|---|---|---|---|---|
| | RC_AA280929_5_at | 199 | AA280929 | ESTs | −2.1 | 0.028189798 |
| | W63793_at | 1020 | W63793 | S-adenosylmethionine decarboxylase 16q21-q22 | −2.1 | 0.032076011 |
| | RC_R36881_s_at | 819 | R36881 | *Homo sapiens* DNA from chromosome 19-cosmid R30879 containing USF2, genomic sequence | −2.1 | 0.007343473 |
| | RC_AA278767_s_at | 188 | AA278767 | ESTs | −2.1 | 0.001983494 |
| | RC_R98442_at | 867 | R98442 | ESTs | −2.1 | 0.007227226 |
| | X99728_at | 1098 | X99728 | H. sapiens NDUFV3 gene, exon 3. | −2.1 | 0.001404191 |
| | RC_R09379_at | 807 | R09379 | solute carrier family 11 (proton-coupled divalent metal ion transporters), member 212q13 | −2.1 | 0.006004344 |
| Up-regulated | RC_AA410383_at | 277 | AA410383 | B-cell-homing chemokine (ligand for Burkitt's lymphoma receptor-1)4q21 | 22.5 | 0.025197485 |
| | RC_R99092_at | 868 | R99092 | EST, Moderately similar to (define not available 5052951) [*H. sapiens*] | −2.1 | 0.016256526 |
| | X95325_s_at | 1095 | X95325 | cold shock domain protein A12p13.1 | −2.1 | 0.025953179 |
| | RC_T56281_f_at | 902 | T56281 | Human metallothionein (MT)I-F gene | −2.1 | 0.032089569 |
| | RC_R44397_at | 835 | R44397 | ESTs | −2.1 | 0.000265391 |
| | RC_H27180_f_at | 568 | H27180 | ESTs | −2.1 | 0.004317675 |
| | AA165312_at | 103 | AA165312 | ESTs | −2.1 | 0.025559572 |
| | RC_AA279313_s_at | 191 | AA279313 | methyl CpG binding protein 2Xq28 | −2.1 | 0.030594523 |
| | HG4322-HT4592_at | 465 | AF141349 | *Homo sapiens* beta-tubulin mRNA, complete cds. | −2.1 | 0.017120749 |
| | RC_H81413_f_at | 597 | H81413 | high-mobility group (nonhistone chromosomal) protein isoforms I and Y6p21 | −2.1 | 0.009976588 |
| | RC_W94333_at | 1039 | W94333 | ESTs, Highly similar to (define not available 5107163) [*H. sapiens*] | −2.1 | 0.000435688 |
| | RC_AA455070_at | 369 | AA455070 | eukaryotic translation initiation factor 3, subunit 1 (alpha, 35kD) | −2.1 | 0.025226928 |
| | RC_R11526_f_at | 809 | R11526 | parathymosin17q12-q22 | −2.1 | 0.027182202 |
| | RC_T15409_f_at | 877 | T15409 | EST | −2.1 | 0.001478856 |
| | RC_H05625_f_at | 548 | H05625 | ESTs | −2.1 | 0.024564209 |
| | RC_AA620461_at | 452 | AA620461 | ESTs | −2.0 | 0.022844667 |
| | RC_AA449791_f_at | 356 | AA449791 | EST | −2.0 | 0.025394324 |
| | RC_AA435769_s_at | 330 | AA435769 | ESTs | −2.0 | 0.008375153 |
| | RC_N55502_at | 755 | N55502 | ESTs | −2.0 | 0.021894439 |
| | AF001294_at | 463 | AF001294 | tumor suppressing subtransferable candidate 311p15.5 | −2.0 | 0.03566128 |
| | RC_Z40898_at | 1118 | Z40898 | ESTs, Highly similar to (defline not available 4929639) [*H. sapiens*] | −2.0 | 0.002289892 |
| | RC_AA436861_at | 340 | AA436861 | ESTs | −2.0 | 0.00187676 |
| | M63573_at | 697 | M63573 | peptidyiprolyl isomerase B (cyclophilin B)15 | −2.0 | 0.044239663 |
| | RC_T25732_f_at | 888 | T25732 | KIAA0252 protein | −2.0 | 0.041237995 |
| | RC_R01257_at | 803 | R01257 | ESTs, Weakly similar to (defline not available 4456991) [*H. sapiens*] | −2.0 | 0.005735841 |
| | RC_H91703_i_at | 603 | H91703 | cell division cycle 2717q12-17q23.2 | −2.0 | 0.001412925 |
| | RC_N34817_at | 739 | N34817 | ESTs | −2.0 | 0.040996591 |
| | RC_R60777_at | 850 | R60777 | ESTs, Weakly similar to KIAA0374 [*H. sapiens*] | −2.0 | 0.000245565 |
| | RC_AA386264_at | 245 | AA386264 | ESTs, Weakly similar to MICROTUBULE-ASSOCIATED PROTEIN 1B [*M. musculus*] | −2.0 | 0.000541139 |
| | RC_AA251769_at | 168 | AA251769 | ESTs, Weakly similar to Containing ATP/GTP-binding site motif A(P-loop): Similar to *C. elegans* protein(P1:CEC47E128);Similar to Mouse alpha-mannosidase(P1:B54407) [*H. sapiens*] | −2.0 | 0.008985897 |
| | RC_R56602_at | 846 | R56602 | Ig superfamily proteinXq12-q13.3 | −2.0 | 0.024051216 |
| | RC_AA397919_at | 247 | AA397919 | ESTs | −2.0 | 0.029784087 |
| Up-regulated | RC_AA410383_at | 277 | AA410383 | B-cell-homing chemokine (ligand for Burkitt's lymphoma receptor-1)4q21 | 22.5 | 0.025197485 |
| | RC_W37778_f_at | 1002 | W37778 | ESTs, Weakly similar to envelope protein [*H. sapiens*] | −2.0 | 0.043013942 |
| | AA248555_at | 164 | AA248555 | ESTs | −2.0 | 0.000824698 |
| | RC_AA463693_at | 385 | AA463693 | ESTs, Weakly similar to SERINE/THREONINE-PROTEIN KINASE NEK3 [*H. sapiens*] | −2.0 | 0.002809026 |

TABLE 1-continued

Normal1-Normal2 vs BPH-With Symptoms

| Affymetrix element | SEQ ID NO: | Genbank ID | Genbank Name | Fold-change N1-N2 vs With | p-value N1-N2 vs With |
|---|---|---|---|---|---|
| W76181_at | 1030 | W76181 | NADH dehydrogenase (ubiquinone) 1 alpha subcomplex, 2 (8kD, B8)5q31 | −2.0 | 0.008370263 |
| RC_AA171939_at | 106 | AA171939 | ESTs | −2.0 | 0.015796116 |
| U30999_at | 961 | U30999 | U30999 Homo sapiens MV3 melanoma Homo sapiens cDNA clone memd | −2.0 | 0.007070546 |
| RC_F03254_f_at | 527 | F03254 | synuclein, alpha (non A4 component of amyloid precursor)4q21 | −2.0 | 0.011479379 |
| RC_H26288_at | 567 | H26288 | ESTs, Weakly similar to !!!! ALU SUBFAMILY SC WARNING ENTRY !!!! [H. sapiens] | −2.0 | 0.000262324 |
| RC_AA007158_f_at | 4 | AA007158 | ESTs | −2.0 | 0.001870921 |
| RC_Z38785_at | 1109 | Z38785 | Homo sapiens clone 23940 mRNA sequence | −2.0 | 0.013437083 |
| RC_AA282247_at | 204 | AA282247 | ESTs | −2.0 | 0.000515617 |
| RC_T23935_s_at | 887 | T23935 | ESTs, Weakly similar to protein-tyrosine phosphatase [H. sapiens] | −2.0 | 0.006493804 |
| RC_R59593_at | 848 | R59593 | ESTs | −2.0 | 0.014592934 |
| RC_AA446241_at | 345 | AA446241 | tropomyosin 2 (beta)9p13.2-p13.1 | −2.0 | 0.040680667 |
| RC_Z40556_at | 1116 | Z40556 | DJ222E13.1a.1 (C-terminal part of novel protein dJ222E13.1) (partial isoform 1) | −2.0 | 0.019444878 |
| RC_AA159025_at | 100 | AA159025 | ESTs, Highly similar to (define not available 4680655) [H. sapiens] | −2.0 | 0.01375696 |
| RC_H03387_s_at | 546 | H03387 | estrogen-responsive B box protein17p11.2 | −2.0 | 0.036382844 |
| RC_H17333_at | 558 | H17333 | EST | −2.0 | 0.018111182 |
| RC_AA412722_s_at | 289 | AA412722 | putative cyclin G1 interacting protein7 | −2.0 | 0.006838915 |
| U65579_at | 979 | U65579 | NADH dehydrogenase (ubiquinone) Fe-S protein 8 (23 kD) (NADH-coenzyme Q reductase)11q13 | −2.0 | 0.013707565 |
| RC_R88209_at | 860 | R88209 | ESTs | −2.0 | 0.040272012 |
| RC_Z38266_at | 1106 | Z38266 | Homo sapiens PAC clone DJ0777O23 from 7p14-p15 | −2.0 | 0.009414008 |

TABLE 2

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| L49169_at | 649 | L49169 | FBJ murine osteosarcoma viral oncogene homolog B19c113.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| V01512_rna1_at | 993 | V01512 | v-fos FBJ murine osteosarcoma viral oncogene homolog14q24.3 | 16.0 | 0.001216643 |
| RC_T90619_f_at | 926 | T90619 | actin, gamma 117q25 | 15.7 | 0.044124187 |
| U20734_s_at | 952 | U20734 | jun B proto-oncogene19p13.2 | 14.3 | 0.004404553 |
| U62015_at | 978 | U62015 | insulin-like growth factor binding protein 101p22-p31 | 13.8 | 0.000487216 |
| AA374109_at | 241 | AA374109 | ESTs, Moderately similar to (define not available 5031506) [R. norvegicus] | 13.0 | 0.025911461 |
| RC_T79768_at | 914 | T79768 | ESTs | 12.2 | 0.018940142 |
| RC_AA410383_at | 277 | AA410383 | B-cell-homing chemokine (ligand for Burkitt's lymphoma receptor-1)4q21 | 11.1 | 0.046025784 |
| X52541_at | 1064 | X52541 | early growth response 15q31.1 | 9.7 | 0.003167537 |
| RC_N66802_at | 767 | N66802 | early growth response 38q23-p21 | 9.7 | 0.026764792 |
| RC_AA463726_s_at | 386 | AA463726 | JM27 proteinXp11.23 | 9.4 | 0.003409168 |
| N40141_at | 743 | N40141 | JM27 proteinXp11.23 | 8.4 | 0.021768214 |
| M34996_s_at | 685 | M34996 | major histocompatibility complex, class II, DQ alpha 16p21.3 | 7.7 | 0.015886207 |
| RC_T67053_f_at | 909 | T67053 | immunoglobulin lambda gene cluster22q11.1-q11.2 | 7.4 | 0.000196865 |
| RC_AA404957_at | 266 | AA404957 | ESTs, Highly similar to MATRIX GLA-PROTEIN PRECURSOR [H. sapiens] | 6.6 | 0.011451385 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| RC_H64493_f_at | 590 | H64493 | immunoglobulin gamma 3 (Gm marker)14q32.33 | 6.5 | 0.002716347 |
| RC_N47686_s_at | 744 | N47686 | solute carrier family 14 (urea transporter), member 1 (Kidd blood group)18q11-q12 | 6.3 | 0.015568892 |
| RC_W44760_s_at | 1006 | W44760 | frizzled-related protein2qter | 6.3 | 0.016891036 |
| L19871_at | 642 | L19871 | activating transcription factor 3 | 6.2 | 0.007603286 |
| M92934_at | 708 | M92934 | connective tissue growth factor6q23.1 | 6.1 | 0.001046931 |
| M62831_at | 695 | M62831 | immediate early protein19 | 5.8 | 0.00753286 |
| L22524_s_at | 643 | L22524 | matrix metalloproteinase 7 (matrilysin, uterine)11q21-q22 | 5.8 | 0.048289798 |
| J03507_at | 621 | J03507 | complement component 75p13 | 5.6 | 0.00240657 |
| RC_AA236455_r_at | 153 | AA236455 | ESTs | 5.5 | 0.022653542 |
| RC_AA450127_at | 359 | AA450127 | growth arrest and DNA-damage-inducible, beta19p13.3 | 5.5 | 0.023227588 |
| RC_AA281345_f_at | 201 | AA281345 | immediate early protein19 | 5.4 | 0.003661068 |
| RC_N30198_at | 733 | N30198 | ESTs | 5.3 | 0.005657756 |
| AFFX-HSAC07/X00351_5_at | 1040 | X00351 | Human mRNA for beta-actin | 5.3 | 0.01547291 |
| D83018_at | 513 | D83018 | nel (chicken)-like 212q13.11-q13.12 | 5.1 | 0.003774757 |
| J04111_at | 624 | J04111 | Jun activation domain binding protein1p32-p31 | 5.0 | 0.000243067 |
| X51345_at | 1062 | X51345 | jun B proto-oncogene19p13.2 | 5.0 | 0.017173421 |
| RC_AA398903_at | 250 | AA398903 | ESTs, Weakly similar to !!!! ALU SUBFAMILY J WARNING ENTRY !!!! [*H. sapiens*] | 4.9 | 0.014577818 |
| RC_H17550_at | 559 | H17550 | ESTs | 4.7 | 0.012079391 |
| S81914_at | 873 | S81914 | immediate early response 36p21.3 | 4.5 | 0.006218653 |
| RC_AA250958_f_at | 167 | AA250958 | EST | 4.4 | 1.88343E−05 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RC_AA446651_at | 346 | AA446651 | ESTs | 4.4 | 0.026022802 |
| HG1872-HT1907_at | 674 | M28590 | Human (clone pcDG-79) MHC HLA-DG protein 41 mRNA, partial cds. | 4.3 | 0.008830524 |
| RC_AA490667_at | 419 | AA490667 | ESTs | 4.3 | 0.048863016 |
| RC_N67041_at | 768 | N67041 | ESTs | 4.1 | 0.009333688 |
| V00563_at | 991 | V00563 | immunoglobulin mu14q32.33 | 4.1 | 0.004301939 |
| X57809_s_at | 1069 | X57809 | immunoglobulin lambda gene cluster22q11.1-q11.2 | 4.1 | 0.025371658 |
| R69417_at | 852 | R69417 | ESTs | 4.1 | 0.046373179 |
| J00231_f_at | 617 | J00231 | immunoglobulin gamma 3 (Gm marker)14q32.33 | 4.0 | 0.004766015 |
| RC_AA402903_f_at | 263 | AA402903 | immunoglobulin gamma 3 (Gm marker)14q32.33 | 3.9 | 0.000172905 |
| U21128_at | 953 | U21128 | lumican12q21.3-q22 | 3.9 | 0.000708917 |
| M12529_at | 655 | M12529 | apolipoprotein E19q13.2 | 3.7 | 0.026856247 |
| RC_AA436616_at | 335 | AA436616 | ESTs | 3.7 | 0.020860083 |
| U72649_at | 983 | U72649 | B-cell translocation gene 2 (pheochromacytoma cell-3)1q32 | 3.7 | 0.002487396 |
| X03689_s_at | 1044 | X03689 | Human mRNA fragment for elongation factor TU (N-terminus) | 3.7 | 0.04821902 |
| AFFX-HSAC07/X00351_5_at | 1040 | X00351 | Human mRNA for beta-actin | 3.6 | 0.029717275 |
| RC_T62857_at | 903 | T62857 | ESTs | 3.6 | 0.002846539 |
| Z74616_s_at | 1123 | Z74616 | collagen, type I, alpha 27q22.1 | 3.6 | 0.004328291 |
| X06700_s_at | 1049 | X06700 | collagen, type III, alpha 1 (Ehlers-Danlos syndrome type IV, autosomal dominant)2q31 | 3.6 | 0.010596098 |
| RC_H86112_f_at | 600 | H86112 | KIAA0471 gene product1q24-q25 | 3.6 | 0.017013968 |
| M57466_s_at | 690 | M57466 | major histocompatibility complex, class II, DP beta 16p21.3 | 3.5 | 0.005924671 |
| RC_F09281_at | 533 | F09281 | ESTs | 3.5 | 0.006841731 |
| RC_R51831_at | 843 | R51831 | ESTs | 3.4 | 0.000941423 |
| RC_H21814_f_at | 563 | H21814 | immunoglobulin lambda gene cluster22q11.1-q11.2 | 3.4 | 0.009767098 |
| RC_W86513_at | 1033 | W86513 | ESTs | 3.4 | 0.003776481 |
| RC_H40424_s_at | 572 | H40424 | EST | 3.4 | 0.016283906 |
| X57025_at | 1066 | X57025 | insulin-like growth factor 1 (somatomedin C)12q22 q23 | 3.3 | 0.040489253 |
| RC_AA044219_at | 29 | AA044219 | BK984G1.1 (PUTATIVE C-terminal end of a novel protein with Collagen triple helix repeats) | 3.3 | 0.001761114 |
| RC_AA028092_s_at | 17 | AA028092 | transcription factor 216pter-qter | 3.3 | 0.003405482 |
| RC_AA446661_at | 347 | AA446661 | ESTs | 3.3 | 0.041188995 |
| RC_D80063_f_at | 506 | D80063 | ESTs | 3.3 | 0.049585142 |
| M92843_s_at | 707 | M92843 | zinc finger protein homologous to Zfp-36 in mouse19q13.1 | 3.3 | 0.006174082 |
| M34516_r_at | 684 | M34516 | immunoglobulin lambda-like polypeptide 322q11.2 | 3.2 | 0.02344053 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| M87789_s_at | 704 | M87789 | immunoglobulin gamma 3 (Gm marker)14q32.33 | 3.2 | 0.004534646 |
| N75870_s_at | 780 | N75870 | dual specificity phosphatase 15q34 | 3.2 | 0.000157434 |
| RC_AA609309_at | 442 | AA609309 | ESTs, Moderately similar to !!!! ALU SUBFAMILY SB2 WARNING ENTRY !!!! [*H. sapiens*] | 3.1 | 0.03780658 |
| S59049_at | 870 | S59049 | regulator of G-protein signalling 11q31 | 3.0 | 0.002419303 |
| AFFX-HUMGAPDH/M33197_5_at | 679 | M33197 | Human GAPDH | 3.0 | 0.034538288 |
| RC_D51060_s_at | 495 | D51060 | Jun activation domain binding protein1p32-p31 | 3.0 | 0.022390037 |
| RC_T23468_at | 884 | T23468 | ESTs | 2.9 | 0.001634616 |
| U30521_at | 960 | U30521 | P311 protein | 2.9 | 0.009484198 |
| Z48501_s_at | 1121 | Z48501 | poly(A)-binding protein-like 13q22-q25 | 2.9 | 0.026396977 |
| W73859_at | 1028 | W73859 | transcription factor 216pter-qter | 2.9 | 0.037326183 |
| AA093923_at | 63 | AA093923 | tissue inhibitor of metalloproteinase 217q25 | 2.8 | 0.041564022 |
| RC_AA236476_at | 154 | AA236476 | ESTs, Weakly similar to (defline not available 4507549) [*H. sapiens*] | 2.7 | 0.038305276 |
| U10550_at | 944 | U10550 | GTP-binding protein overexpressed in skeletal muscle8q13-q21 | 2.7 | 0.040657885 |
| RC_N24902_at | 727 | N24902 | E1B-55kDa-associated protein 5 | 2.7 | 0.03810507 |
| RC_AA056121_at | 46 | AA056121 | ESTs | 2.7 | 0.024285705 |
| RC_H98835_at | 611 | H98835 | ESTs | 2.7 | 0.019901442 |
| K02405_f_at | 629 | K02405 | Human MHC class II HLA-DQ-beta mRNA (DR7 DQw2), complete cds | 2.7 | 0.00138806 |
| U90552_s_at | 988 | U90552 | butyrophilin, subfamily 3, member A16p23 | 2.7 | 3.91186E−05 |
| RC_N59831_at | 759 | N59831 | ESTs | 2.7 | 0.04543669 |
| L33799_at | 645 | L33799 | procollagen C-endopeptidase enhancer7q22 | 2.7 | 0.010879277 |
| RC_N59532_s_at | 758 | N59532 | aminomethyltransferase (glycine cleavage system protein T)3p21.2-p21.1 | 2.6 | 0.025712285 |
| D13628_at | 476 | D13628 | angiopoietin 16q22.3-q23 | 2.6 | 0.027204836 |
| AA156897_s_at | 97 | AA156897 | *Homo sapiens* mRNA; cDNA DKFZp564I1922 (from clone DKFZp564I1922) | 2.6 | 0.001580022 |
| RC_N67876_s_at | 773 | N67876 | insulin-like growth factor 1 (somatomedin C)12q22 q23 | 2.6 | 0.03992641 |
| M73720_at | 702 | M73720 | carboxypeptidase A3 (mast cell)3q21-q25 | 2.6 | 0.023298997 |
| H49440_at | 578 | H49440 | nudix (nucleoside diphosphate linked moiety X)-type motif 36p21.2 | 2.6 | 0.002498701 |
| RC_AA250850_at | 166 | AA250850 | adrenergic, beta, receptor kinase 222q11 | 2.5 | 0.041156086 |
| RC_T49061_at | 894 | T49061 | ESTs | 2.5 | 0.00934004 |
| W28214_at | 996 | W28214 | ESTs | 2.5 | 0.037677921 |
| RC_H44631_s_at | 573 | H44631 | immediate early protein19 | 2.5 | 0.0423037 |
| D28137_at | 484 | D28137 | bone marrow stromal cell antigen 219p13.2 | 2.5 | 0.026212334 |
| RC_AA609027_at | 441 | AA609027 | ESTs | 2.5 | 0.038550623 |
| RC_AA257093_r_at | 178 | AA257093 | T-cell receptor, beta cluster7q35 | 2.4 | 0.002653232 |
| RC_F13763_at | 542 | F13763 | ESTs | 2.4 | 0.016949277 |
| RC_H08548_s_at | 550 | H08548 | ATP citrate lyase17q12-q21 | 2.4 | 0.036998522 |
| RC_AA436618_at | 336 | AA436618 | ESTs | 2.4 | 0.001789907 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RC_W45664_s_at | 1008 | W456645 | nucleotidase (CD73)6q14-q21 | 2.4 | 0.001762727 |
| AA082546_at | 54 | AA082546 | ESTs | 2.4 | 0.021791878 |
| D10522_at | 471 | 010522 | myristoylated alanine-rich protein kinase C substrate (MARCKS, 80 K-L)6q22.2 | 2.4 | 0.017333686 |
| RC_AA411860_at | 280 | AA411860 | ESTs, Highly similar to (defline not available 4929723) [*H. sapiens*] | 2.4 | 0.02766922 |
| AB002340_at | 461 | AB002340 | KIAA0342 gene product | 2.3 | 0.003238699 |
| U53445_at | 972 | U53445 | downregulated in ovarian cancer 13 | 2.3 | 0.009361652 |
| AA091278_at | 60 | AA091278 | ESTs | 2.3 | 0.046253689 |
| RC_AA486072_i_at | 410 | AA486072 | small inducible cytokine A5 (RANTES)17q11.2-q12 | 2.3 | 0.012816473 |
| RC_T53590_s_at | 899 | T53590 | cytochrome P450, subfamily XIA (cholesterol side chain cleavage)15q23-q24 | 2.3 | 4.29636E−05 |
| RC_N91971_f_at | 791 | N91971 | retinol-binding protein 1, cellular3q23 | 2.3 | 0.025171598 |
| RC_AA043777_at | 28 | AA043777 | ESTs | 2.3 | 0.004490188 |
| RC_H54764_at | 580 | H54764 | EST, Weakly similar to X-linked retinopathy protein {C-terminal, clone XEH.8c} [*H. sapiens*] | 2.3 | 0.036980431 |
| RC_AA443923_at | 344 | AA443923 | ESTs | 2.3 | 0.025833241 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| U60975_at | 977 | U60975 | *Homo sapiens* gp250 precursor, mRNA, complete cds. | 2.3 | 0.041238204 |
| M34516_at | 684 | M34516 | immunoglobulin lambda-like polypeptide 322q11.2 | 2.3 | 0.041388637 |
| RC_N36001_at | 740 | N36001 | ESTs, Weakly similar to !!!! ALU CLASS C WARNING ENTRY !!!! [*H. sapiens*] | 2.2 | 0.000449076 |
| AF010193_at | 464 | AF010193 | MAD (mothers against decapentaplegic, Drosophila) homolog 718 | 2.2 | 0.005397771 |
| AFFX-HSAC07/X00351_5_at | 1040 | X00351 | Human mRNA for beta-actin | 2.2 | 0.037852217 |
| RC_AA158262_s_at | 99 | AA158262 | calpastatin5q14–q22 | 2.2 | 0.006648962 |
| RC_AA156565_at | 96 | AA156565 | 4-nitrophenylphosphatase domain and non-neuronal SNAP25-like 122q12 | 2.2 | 0.020901922 |
| Z11793_at | 1104 | Z11793 | selenoprotein P, plasma, 15q31 | 2.2 | 0.00118281 |
| RC_D80059_s_at | 504 | D80059 | ESTs | 2.2 | 0.033534432 |
| RC_AA450324_at | 360 | AA450324 | ESTs | 2.2 | 0.024832006 |
| RC_N39415_at | 742 | N39415 | osteoglycin (osteoinductive factor) | 2.2 | 0.032001116 |
| RC_T23622_at | 886 | T23622 | ESTs | 2.2 | 0.040417825 |
| RC_AA599365_at | 434 | AA599365 | decorin12q23 | 2.2 | 0.011325181 |
| X62320_at | 1073 | X62320 | granulin17 | 2.2 | 0.043043858 |
| RC_R85291_at | 859 | R85291 | ESTs | 2.2 | 0.004987693 |
| M11313_s_at | 654 | M11313 | alpha-2-macroglobulin12p13.3-p12.3 | 2.2 | 0.011545737 |
| AA047151_at | 37 | AA047151 | ESTs | 2.2 | 0.033987576 |
| RC_AA205724_at | 123 | AA205724 | ESTs | 2.2 | 0.004569368 |
| RC_AA086264_i_at | 59 | AA086264 | ESTs, Highly similar to (defline not available 4191348) [*H. sapiens*] | 2.2 | 0.020637423 |
| RC_R42424_at | 832 | R42424 | ESTs | 2.2 | 0.033603417 |
| RC_AA347359_s_at | 233 | AA347359 | lysozyme (renal amyloidosis)12 | 2.1 | 0.028764499 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| AA092716_at | 62 | AA092716 | HLA-B associated transcript-36p21.3 | 2.1 | 0.031717351 |
| RC_R42241_at | 830 | R42241 | ESTs | 2.1 | 0.008013968 |
| RC_N57577_at | 756 | N57577 | KIAA0663 gene product | 2.1 | 0.032028875 |
| RC_W67577_s_at | 1022 | W67577 | CD74 antigen (invariant polypeptide of major histocompatibility complex, class II antigen-associated)5q32 | 2.1 | 0.002072118 |
| C02016_at | 466 | C02016 | KIAA0447 gene product | 2.1 | 0.002399894 |
| RC_AA256268_at | 175 | AA256268 | ESTs | 2.1 | 0.0269568 |
| RC_T96171_at | 930 | T96171 | EST | 2.1 | 0.012219229 |
| X72841_at | 1083 | X72841 | retinoblastoma-binding protein 7 | 2.1 | 0.033774692 |
| RC_R45698_at | 839 | R45698 | ESTs | 2.1 | 0.049975895 |
| RC_N22006_s_at | 719 | N22006 | EST | 2.1 | 0.011131338 |
| RC_N69222_at | 777 | N69222 | ESTs | 2.1 | 0.022256915 |
| RC_H97538_at | 607 | H97538 | ESTs | 2.0 | 0.03795259 |
| RC_AA039935_at | 23 | AA039935 | dynein light chain, outer arm 422q12.3–q13.2 | 2.0 | 0.011488766 |
| RC_AA084138_at | 55 | AA084138 | ESTs | 2.0 | 0.011124432 |
| AB002379_at | 462 | AB002379 | KIAA0381 protein | 2.0 | 0.000530413 |
| RC_AA460651_at | 379 | AA460651 | heterogeneous nuclear protein similar to rat helix destabilizing protein10 | 2.0 | 0.027697892 |
| RC_W02204_at | 994 | W02204 | solute carrier family 24 (sodium/potassium/calcium exchanger), member 115q22 | 2.0 | 0.00115779 |
| Y08614_at | 1101 | Y08614 | exportin 1 (CRM1, yeast, homolog)2p16 | 2.0 | 0.035368368 |
| D31134_at | 488 | D31134 | KIAA1075 protein | 2.0 | 0.021196526 |
| M94880_f_at | 711 | M94880 | major histocompatibility complex, class I, A6p21.3 | 2.0 | 0.025382167 |
| J03040_at | 619 | J03040 | secreted protein, acidic, cysteine-rich (osteonectin)5q31.3-q32 | 2.0 | 0.035472553 |
| RC_N68350_at | 775 | N68350 | ESTs | 2.0 | 0.042917893 |
| RC_H48793_at | 577 | H48793 | EST | 2.0 | 0.00296551 |
| HG3543-HT3739_at | 675 | M29645 | insulin-like growth factor 2 (somatomedin A)11p15.5 | 2.0 | 0.019712374 |
| RC_W33172_at | 999 | W33172 | ESTs, Weakly similar to ORF2 [*M. musculus*] | 2.0 | 0.006454106 |
| RC_R08850_at | 806 | R08850 | ESTs | 2.0 | 0.011364766 |
| W52638_at | 1014 | W52638 | ESTs | 2.0 | 0.010612401 |
| M19045_f_at | 662 | M19045 | lysozyme (renal amyloidosis)12 | 2.0 | 0.004561974 |
| RC_AA312946_s_at | 228 | AA312946 | ESTs | 2.0 | 0.020272205 |
| RC_AA235310_at | 148 | AA235310 | ESTs | 2.0 | 0.011954937 |
| X03100_cds2_at | 1043 | X03100 | Human mRNA for SB classII histocompatibility antigen alpha-chain | 2.0 | 0.002404541 |
| RC_T16282_f_at | 881 | T16282 | wee1 + (S. pombe)homolog11p15.3-p15.1 | 2.0 | 0.031472155 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| RC_H66642_f_at | 591 | H66642 | ESTs, Moderately similar to !!!! ALU SUBFAMILY SQ WARNING ENTRY !!!! [*H. sapiens*] | 2.0 | 0.02460529 |
| RC_AA342337_at | 231 | AA342337 | ESTs, Moderately similar to !!!! ALU SUBFAMILY SQ WARNING ENTRY !!!! [*H. sapiens*] | −23.7 | 3.26344E−05 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RC_AA398908_at | 251 | AA398908 | Human Chromosome 16 BAC clone CIT987SK-A-61E3 | −21.7 | 0.040053626 |
| RC_H15143_s_at | 554 | H15143 | Human clone 23575 mRNA, partial cds | −13.8 | 0.028261625 |
| RC_N80129_i_at | 785 | N80129 | metallothionein 1L16q13 | −12.6 | 0.002146038 |
| RC_AA465394_at | 390 | AA465394 | ESTs | −12.6 | 0.004961162 |
| RC_AA236545_at | 156 | AA236545 | ESTs | −12.5 | 0.034938167 |
| RC_W42778_at | 1004 | W42778 | *Homo sapiens* clone 24636 mRNA sequence | −12.3 | 0.010449419 |
| RC_T40895_at | 892 | T40895 | ESTs | −12.0 | 0.01968535 |
| RC_H94475_s_at | 605 | H94475 | alpha-2-plasmin inhibitor17pter-p12 | −11.7 | 0.012919819 |
| RC_R71792_s_at | 855 | R71792 | ESTs, Moderately similar to FAT-SPECIFIC PROTEIN FSP27 [*M. musculus*] | −10.4 | 0.002540356 |
| RC_AA609006_at | 440 | AA609006 | ESTs | −7.5 | 0.013902978 |
| RC_AA026641_s_at | 16 | AA026641 | secretory leukocyte protease inhibitor (antileukoproteinase) | −7.0 | 0.01850877 |
| X65614_at | 1076 | X65614 | S100 calcium-binding protein P4p16 | −6.7 | 0.005634308 |
| X93036_at | 1093 | X93036 | phospholemman-like, expressed in breast tumors, 8 kD | −6.6 | 0.005278275 |
| RC_T94447_s_at | 928 | T94447 | ESTs, Moderately similar to (defline not available 4335935) [*M. musculus*] | −5.7 | 0.006891909 |
| RC_AA405488_at | 268 | AA405488 | ESTs | −5.5 | 0.00023986 |
| RC_T73433_s_at | 912 | T73433 | angiotensinogen1q41-qter | −5.5 | 0.009418205 |
| M99487_at | 716 | M99487 | folate hydrolase (prostate-specific membrane antigen) 111p11.2 | −5.3 | 0.008067789 |
| RC_W88568_at | 1035 | W88568 | glycogenin 2Xp22.3 | −5.1 | 0.024739084 |
| RC_AA460914_at | 380 | AA460914 | ESTs | −5.0 | 0.024385552 |
| X57129_at | 1067 | X57129 | H1 histone family, member 26p21.3 | −4.8 | 0.006322499 |
| RC_Z41642_at | 1119 | Z41642 | ESTs | −4.7 | 0.009525521 |
| RC_R46074_at | 840 | R46074 | transforming, acidic coiled-coil containing protein 210q26 | −4.7 | 0.001327844 |
| J03910_rna1_at | 622 | J03910 | metallothionein 1G16q13 | −4.6 | 0.004574277 |
| RC_AA350265_at | 237 | AA350265 | histone deacetylase A | −4.5 | 0.002897414 |
| AA165312_at | 103 | AA165312 | ESTs | −4.2 | 0.005487803 |
| RC_AA419011_at | 296 | AA419011 | *Homo sapiens* mRNA; cDNA DKFZp586D0823 (from clone DKFZp58600823) | −4.0 | 0.019079557 |
| RC_N92502_s_at | 794 | N92502 | ESTs, Moderately similar to HERV-E integrase [*H. sapiens*] | −4.0 | 0.030144039 |
| RC_F03969_at | 528 | F03969 | ESTs, Weakly similar to tumorous imaginal discs protein Tid56 homolog [*H. sapiens*] | −4.0 | 0.017024613 |
| X76717_at | 1087 | X76717 | metallothionein 1L16q13 | −3.9 | 0.001145402 |
| RC_AA416762_s_at | 291 | AA416762 | nuclear receptor subfamily 1, group H, member 219q13.3-19q13.3 | −3.8 | 0.011735303 |
| RC_AA053424_at | 40 | AA053424 | ESTs, Weakly similar to mucin Muc3 [*R. norvegicus*] | −3.8 | 0.009737433 |
| X64177_f_at | 1075 | X64177 | metallothionein 1H16q13 | −3.7 | 0.003297195 |
| RC_N32748_at | 736 | N32748 | ESTs | −3.6 | 0.021454174 |
| RC_AA416685_at | 290 | AA416685 | UNC13 (C. elegans)-like9p11-p12 | −3.6 | 0.016338392 |
| RC_AA505136_at | 426 | AA505136 | ESTs | −3.5 | 0.007200396 |
| RC_AA165313_at | 104 | AA165313 | ESTs | −3.5 | 0.037649191 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RCF02245_at | 522 | F02245 | monoamine oxidase AXp11.4-p11.3 | −3.4 | 0.005486135 |
| RC_AA004699_at | 1 | AA004699 | putative translation initiation factor | −3.4 | 0.00057505 |
| RC_AA599331_at | 433 | AA599331 | ESTs | −3.4 | 0.01136457 |
| RC_N26904_at | 731 | N26904 | ESTs, Weakly similar to FK506/rapamycin-binding protein FKBP13 precursor [*H. sapiens*] | −3.3 | 0.045410608 |
| RC_AA070752_s_at | 51 | AA070752 | insulin receptor substrate 12q36 | −3.3 | 0.028433761 |
| RC_AA599522_f_at | 437 | AA599522 | squamous cell carcinoma antigen recognised by T cells | −3.2 | 0.005311305 |
| RC_N94303_at | 797 | N94303 | ESTs | −3.1 | 0.000160723 |
| RC_F10078_at | 538 | F10078 | ESTs | −3.1 | 0.022464594 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| RC_AA447537_at | 350 | AA447537 | ESTs, Moderately similar to (defline not available 5360237) [*M. musculus*] | −3.1 | 0.007323728 |
| L77701_at | 651 | L77701 | human homolog of yeast mitochondrial copper recruitment gene | −3.0 | 0.001489928 |
| RC_H27675_at | 569 | H27675 | ESTs | −3.0 | 0.016160504 |
| V00594_at | 992 | V00594 | metallothionein 2A16q13 | −2.9 | 0.001495259 |
| U52969_at | 970 | U52969 | Purkinje cell protein 421q22.2-q22.3 | −2.9 | 6.3447E−05 |
| RC_R42607_at | 834 | R42607 | ESTs | −2.8 | 0.008960052 |
| RC_AA451836_at | 362 | AA451836 | ESTs | −2.7 | 0.008401586 |
| RC_F04492_at | 531 | F04492 | ESTs, Weakly similar to !!!! ALU SUBFAMILY J WARNING ENTRY !!!! [*H. sapiens*] | −2.7 | 0.001443051 |
| RC_H77597_f_at | 594 | H77597 | metallothionein 1H16q13 | −2.7 | 0.00332868 |
| RC_AA430388_at | 321 | AA430388 | ESTs, Moderately similar to !!!! ALU SUBFAMILY SQ WARNING ENTRY !!!! [*H. sapiens*] | −2.7 | 0.000114004 |
| RC_T90190_s_at | 925 | T90190 | H1 histone family, member 26p21.3 | −2.7 | 0.030242714 |
| RC_H16171_f_at | 555 | H16171 | cleft lip and palate associated transmembrane protein 119q13.2-q13.3 | −2.7 | 0.023414443 |
| RC_AA022886_at | 14 | AA022886 | ESTs, Weakly similar to phosphatidylinositol transfer protein [*H. sapiens*] | −2.7 | 0.00489294 |
| RC_R28370_at | 815 | R28370 | ESTs | −2.7 | 0.003724547 |
| RC_AA261907_at | 182 | AA261907 | ESTs, Weakly similar to (define not available 3874144) [*C. elegans*] | −2.6 | 0.043689441 |
| RC_W37778_f_at | 1002 | W37778 | ESTs, Weakly similar to envelope protein [*H. sapiens*] | −2.6 | 0.030756837 |
| RC_T98019_at | 932 | T98019 | EST, Highly similar to PEREGRIN [*H. sapiens*] | −2.5 | 0.035566681 |
| RC_N33927_s_at | 737 | N33927 | H2B histone family, member B6p21.3 | −2.5 | 0.013093926 |
| RC_R40431_at | 828 | R40431 | Homo sapiens mRNA; cDNA DKFZp564D016 (from clone DKFZp564D016) | −2.5 | 0.004235538 |
| RC_AA133756_at | 78 | AA133756 | Rho-associated, coiled-coil containing protein kinase 22p24 | −2.5 | 0.012389163 |
| RC_AA152200_s_at | 92 | AA152200 | ESTs | −2.5 | 0.004366137 |
| W63793_at | 1020 | W63793 | S-adenosylmethionine decarboxylase 16q21-q22 | −2.5 | 0.005714247 |
| RC_AA410298_at | 274 | AA410298 | ESTs | −2.5 | 0.018744617 |
| X99728_at | 1098 | X99728 | *H. sapiens* NDUFV3 gene, exon 3 | −2.5 | 0.004580383 |
| RC_W78127_at | 1031 | W78127 | ESTs, Weakly similar to KIAA0425 [*H. sapiens*] | −2.5 | 0.001240164 |
| L49169_at | 649 | L49169 | FBJ murine osteosarcoma viral oncogene homolog 819q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RC_R96924_a_at | 866 | R96924 | ESTs | −2.5 | 0.006515911 |
| RC_H16768_at | 557 | H16768 | ESTs | −2.5 | 0.005669237 |
| X76180_at | 1086 | X76180 | sodium channel, nonvoltage-gated 1 alpha12p13 | −2.5 | 0.007625025 |
| RC_AA432162_at | 324 | AA432162 | Homo sapiens mRNA; cDNA DKFZp58682022 (from clone DKFZp586B2022) | −2.4 | 0.010199113 |
| RC_H88798_at | 602 | H88798 | ESTs | −2.4 | 0.000783143 |
| RC_AA609312_at | 443 | AA609312 | ESTs | −2.4 | 0.016243321 |
| RC_AA131919_at | 75 | AA131919 | putative type II membrane protein | −2.4 | 0.000264791 |
| RC_N80129_f_at | 785 | N80129 | metallothionein 1L16q13 | −2.4 | 0.002297016 |
| RC_AA182030_at | 110 | AA182030 | ESTs | −2.4 | 0.041632378 |
| W70167_at | 1025 | W70167 | ESTs | −2.4 | 0.00395969 |
| RC_AA599522_r_at | 437 | AA599522 | squamous cell carcinoma antigen recognised by T cells | −2.4 | 0.004347078 |
| RC_N52254_s_at | 749 | N52254 | SH3-binding domain glutamic acid-rich protein21q22.3 | −2.4 | 0.011171389 |
| RC_N95495_at | 799 | N95495 | small inducible cytokine A5 (RANTES)17q11.2-q12 | −2.4 | 0.002430242 |
| RC_T68873_f_at | 911 | T68873 | metallothionein 1L16q13 | −2.4 | 0.00320019 |
| AA429539_f_at | 318 | AA429539 | ESTs | −2.4 | 0.020751882 |
| RC_AA435769_s_at | 330 | AA435769 | ESTs | −2.4 | 0.009832353 |
| RC_AA029356_at | 18 | AA029356 | ESTs | −2.3 | 0.007208722 |
| AA316686_s_at | 229 | AA316686 | ESTs, Highly similar to huntingtin interacting protein HYPK [*H. sapiens*] | −2.3 | 0.000225753 |
| RC_H02308_at | 545 | H02308 | ESTs | −2.3 | 0.041776289 |
| RC_AA258476_at | 179 | AA258476 | Homo sapiens mRNA; cDNA DKFZp564J0323 (from clone DKFZp564J0323) | −2.3 | 0.02070961 |
| X06956_at | 1051 | X06956 | tubulin, alpha 1 (testis specific)2q | −2.3 | 0.003656874 |
| RC_H99694_at | 614 | H99694 | ESTs | −2.3 | 0.013645335 |
| RC_AA479044_s_at | 402 | AA479044 | ESTs, Weakly similar to PROGASTRICSIN PRECURSOR [*H. sapiens*] | −2.3 | 0.047032301 |
| RC_AA436861_at | 340 | AA436861 | ESTs | −2.3 | 0.001794201 |
| M24069_at | 672 | M24069 | cold shock domain protein A12p13.1 | −2.3 | 0.014123514 |
| RC_AA410311_at | 275 | AA410311 | ESTs | −2.3 | 0.045227011 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| W52858_at | 1015 | W52858 | Homo sapiens mRNA; cDNA DKFZp564F0522 (from clone DKFZp564F0522) | −2.3 | 0.002276405 |
| RC_W38197_at |  | W38197 | EST | −2.3 | 1.96016E−05 |
| J00073_at | 615 | J00073 | actin, alpha, cardiac muscle15q11-qter | −2.3 | 0.018476889 |
| RC_D51069_f_at | 496 | D51069 | melanoma adhesion molecule | −2.3 | 0.042693395 |
| RC_AA504805_s_at | 424 | AA504805 | interferon stimulated gene (20 kD)15q26 | −2.3 | 0.008805886 |
| RC_F03254_f_at | 527 | F03254 | synuclein, alpha (non A4 component of amyloid precursor)4q21 | −2.3 | 0.003668915 |
| M35252_at | 686 | M35252 | tranamembrane 4 superfamily member 3 | −2.3 | 0.028083185 |
| RC_AA040731_at | 25 | AA040731 | ESTs | −2.2 | 0.028924808 |
| RC_AA496247_at | 422 | AA496247 | ESTs | −2.2 | 0.013336314 |
| X59766_at | 1071 | X59766 | alpha-2-glycoprotein 1, zinc 7 | −2.2 | 0.002003511 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog14q24.3 | 16.5 | 8.98673E−05 |
| RC_R84421_at | 857 | R84421 | eukaryotic translation elongation factor 1 alpha 16q14 | −2.2 | 0.016333706 |
| AA328993_s_at | 230 | AA328993 | ESTs | −2.2 | 0.004438605 |
| RC_R44535_f_at | 836 | R44535 | endonuclease G9q34.1 | −2.2 | 0.014319616 |
| U41518_at | 964 | U41518 | aquaporin 1 (channel-forming integral protein, 28 kD)7p14 | −2.2 | 0.009447457 |
| RC_W33179_at | 1000 | W33179 | testis-specific kinase 21p32 | −2.2 | 0.001104272 |
| RC_H58873_s_at | 583 | H58873 | solute carrier family 2 (facilitated glucose transporter), member 11p35-p31.3 | −2.2 | 0.000238641 |
| RC_R31679_s_at | 816 | R31679 | ESTs | −2.2 | 0.01000414 |
| RC_AA189083_at | 114 | AA189083 | ESTs, Highly similar to (defline not available 4589468) [M. musculus] | −2.2 | 0.002468046 |
| RC_AA251769_at | 168 | AA251769 | ESTs, Weakly similar to Containing ATP/GTP-binding site motif A(P-loop): Similar to C. elegans protein(P1:CEC47E128); Similar to Mouse alpha-mannosidase(P1:B54407) [H. sapiens] | −2.2 | 0.010819016 |
| RC_W70131_at | 1024 | W70131 | ESTs | −2.2 | 0.02955725 |
| RC_R09379_at | 807 | R09379 | solute carrier family 11 (proton-coupled divalent metal ion transporters), member 212q13 | −2.2 | 0.009730513 |
| RC_AA621695_at | 458 | AA621695 | ESTs | −2.1 | 0.001994051 |
| RC_H18947_at | 561 | H18947 | ESTs | −2.1 | 0.027246274 |
| RC_AA219552_s_at | 134 | AA219552 | ESTs | −2.1 | 0.046510941 |
| RC_N22620_at | 722 | N22620 | ESTs | −2.1 | 0.013527392 |
| RC_R02003_r_at | 804 | R02003 | ESTs, Weakly similar to cappuccino [D. melanogaster] | −2.1 | 0.010597095 |
| RC_AA405559_at | 270 | AA405559 | ESTs | −2.1 | 0.009305601 |
| RC_AA463693_at | 385 | AA463693 | ESTs, Weakly similar to SERINE/THREONINE-PROTEIN KINASE NEK3 [H. sapiens] | −2.1 | 0.004156996 |
| RC_AA481407_at | 405 | AA481407 | ESTs | −2.1 | 0.002741696 |
| M11119_at | 653 | M11119 | Human endogenous retrovirus envelope region mRNA (PL1) | −2.1 | 0.003718876 |
| RC_AA159025_at | 100 | AA159025 | ESTs, Highly similar to (defline not available 4680655) [H. sapiens] | −2.1 | 0.011127532 |
| RC_AA411981_at | 283 | AA411981 | ESTs, Weakly similar to putative seven pass transmembrane protein [H. sapiens] | −2.1 | 0.044294612 |
| RC_W57931_at | 1017 | W57931 | ESTs, Moderately similar to CATHEPSIN D PRECURSOR [H. sapiens] | −2.1 | 0.000755739 |
| X66899_at | 1081 | X66899 | Ewing sarcoma breakpoint region 122q12 | −2.1 | 0.002068901 |
| RC_R49327_at | 842 | R49327 | solute carrier family 11 (proton-coupled divalent metal ion transporters), member 212q13 | −2.1 | 0.030928835 |
| RC_AA609645_at | 445 | AA609645 | eukaryotic translation initiation factor 4 gamma, 13q27-qter | −2.1 | 0.04955957 |
| RC_AA434108_at | 327 | AA434108 | Homo sapiens heat shock protein hsp40-3 mRNA, complete cds | −2.1 | 0.034468752 |
| X17567_s_at | 1061 | X17567 | small nuclear ribonucleoprotein polypeptides B and B120 | −2.1 | 0.014475221 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog 14q24.3 | 16.5 | 8.98673E−05 |
| J04164_at | 626 | J04164 | interferon-induced protein 17 | −2.1 | 0.023410352 |
| RC_AA135929_s_at | 80 | AA135929 | ESTs, Highly similar to (defline not available 4103057) [M. musculus] | −2.1 | 0.003009065 |
| L04270_at | 634 | L04270 | lymphotoxin beta receptor (TNFR superfamily, member 312p13 | −2.1 | 0.006776988 |
| RC_H99035_at | 612 | H99035 | ESTs | −2.1 | 0.001053584 |
| M64673_at | 698 | M64673 | heat shock transcription factor 1 | −2.1 | 0.004283001 |

TABLE 2-continued

Normal1-Normal2 vs BPH-Cancer (Up-regulated)

| Affymetrix element | SEQ ID NO: | Genbank ID | Genbank Name | Fold-Change N1-N2 vs Cancer | p-value N1-N2 vs Cancer |
|---|---|---|---|---|---|
| X85785_rna1_at | 1091 | X85785 | Duffy blood group1q21-q22 | −2.1 | 0.00657464 |
| M68864_at | 700 | M68864 | Human ORF mRNA, complete cds | −2.1 | 0.010185833 |
| D50928_at | 494 | D50928 | KIAA0138 gene product | −2.1 | 0.002283064 |
| RC_AA282247_at | 204 | AA282247 | ESTs | −2.0 | 0.007970044 |
| RC_R00144_at | 801 | R00144 | ESTs | −2.0 | 0.006939854 |
| RC_AA485965_at | 409 | AA485965 | ESTs, Highly similar to (defline not available 4336766) [*H. sapiens*] | −2.0 | 0.000405037 |
| S45630_at | 869 | S45630 | crystallin, alpha B11q22.3-q23.1 | −2.0 | 0.006157273 |
| RC_T89703_at | 923 | T89703 | ESTs, Highly similar to (defline not available 4455129) [*H. sapiens*] | −2.0 | 0.000286616 |
| RC_Z38785_at | 1109 | Z38785 | *Homo sapiens* clone 23940 mRNA sequence | −2.0 | 0.00706437 |
| X85373_at | 1090 | X85373 | small nuclear ribonucleoprotein polypeptide G | −2.0 | 6.93881E−05 |
| RC_F04816_at | 532 | F04816 | ESTs | −2.0 | 0.005353184 |
| RC_AA043349_at | 27 | AA043349 | ESTs | −2.0 | 0.01749596 |
| RC_H84761_s_at | 599 | H84761 | glutathione peroxidase 13p21.3 | −2.0 | 0.000116621 |
| M34338_s_at | 683 | M34338 | spermidine synthase1p36-p22 | −2.0 | 0.008566137 |
| L13698_at | 638 | L13698 | growth arrest-specific 19q21.3-q22.1 | −2.0 | 0.016504513 |
| RC_N75960_at | 781 | N75960 | ESTs | −2.0 | 0.024082428 |
| D45370_at | 491 | D45370 | adipose specific 210 | −2.0 | 0.034362163 |
| RC_AA401965_at | 258 | AA401965 | tumor suppressor deleted in oral cancer-related 111q13 | −2.0 | 0.011190087 |
| RC_F09315_at | 534 | F09315 | discs, large (Drosophila) homolog 510q23 | −2.0 | 0.020753036 |
| RC_AA025370_at | 15 | AA025370 | KIAA0872 protein | −2.0 | 0.026565555 |
| RC_H52835_at | 579 | H52835 | phytanoyl-CoA hydroxylase (Refsum disease)10pter-p11.2 | −2.0 | 0.015021251 |
| RC_H99648_s_at | 613 | H99648 | DNA segment, single copy probe LNS-CAI/LNS-CAII (deleted in polyposis5q22-q23 | −2.0 | 0.012115852 |
| RC_AA430074_at | 320 | AA430074 | ESTs | −2.0 | 0.002355049 |
| RC_AA598939_at | 428 | AA598939 | ESTs | −2.0 | 0.011383872 |
| AA455001_s_at | 368 | AA455001 | ESTs | −2.0 | 0.000176199 |
| RC_F09684_at | 535 | F09684 | ESTs | −2.0 | 0.002741682 |
| D42073_at | 490 | D42073 | reticulocalbin 1, EF-hand calcium binding domain11p13 | −2.0 | 0.012881688 |
| RC_AA598695_at | 427 | AA598695 | ESTs, Weakly similar to !!!! ALU SUBFAMILY SX WARNING ENTRY !!!! [*H. sapiens*] | −2.0 | 4.77268E−06 |
| D23662_at | 481 | D23662 | neural precursor cell expressed, developmentally down-regulated 8 | −2.0 | 0.003156141 |
| RC_AA431470_at | 323 | AA431470 | proteinkinase (cAMP-dependent, catalytic) inhibitor gamma20q | −2.0 | 0.038692982 |
| RC_AA399273_at | 253 | AA399273 | ESTs | −2.0 | 0.029403118 |
| RC_AA142858_at | 82 | AA142858 | ESTs | −2.0 | 0.00197166 |
| L49169_at | 649 | L49169 | FBJ murine osteosarcoma viral oncogene homolog B19q13.3 | 18.8 | 0.03580379 |
| RC_N23730_s_at | 724 | N23730 | v-fos FBJ murine osteosarcoma viral oncogene homolog B4q24.3 | 16.5 | 8.98673E−05 |
| RC_Z40715_at | 1117 | Z40715 | *Homo sapiens* mRNA; cDNA DKFZp586C201 (from clone DKFZp586C201) | −2.0 | 0.017206338 |
| RC_AA490341_s_at | 417 | AA490341 | ESTs | −2.0 | 0.004570941 |
| RC_N67815_f_at | 772 | N67815 | ESTs, Weakly similar to (defline not available 4660655) [*H. sapiens*] | −2.0 | 0.002996692 |
| RC_N53359_at | 750 | N53359 | ESTs | −2.0 | 0.034916164 |

TABLE 3

Normal vs. BPH W/Symptoms (Up-regulated)

| Affymetrix element | SEQ ID NO: | GenBank ID | GenBank Name | Fold-change | t |
|---|---|---|---|---|---|
| N40141_at | 743 | N40141 | JM27 protein | 17.4 | −7.64 |
| rc_N23730_s_at | 724 | N23730 | v-fos FBJ murine osteosarcoma viral oncogene homolog | 10.8 | −7.54 |
| rc_AA463726_s_at | 386 | AA463726 | JM27 protein | 10.0 | −6.56 |
| rc_N23352_s_at | 723 | N23352 | proenkephalin | 10.0 | −4.53 |
| rc_H64493_f_at | 590 | H64493 | immunoglobulin heavy constant gamma 3 (G3m marker) | 9.1 | −4.36 |
| V01512_rna1_at | 993 | V01512 | v-fos FBJ murine osteosarcoma viral oncogene homolog | 9.1 | −7.40 |
| rc_H05704_r_at | 549 | H05704 | HCR (a-helix coiled-coil rod homologue) | 8.1 | −2.79 |

TABLE 3-continued

Normal vs. BPH W/Symptoms (Up-regulated)

| Affymetrix element | SEQ ID NO: | GenBank ID | GenBank Name | Fold-change | t |
|---|---|---|---|---|---|
| L49169_at | 649 | L49169 | FBJ murine osteosarcoma viral oncogene homolog B | 8.0 | −5.81 |
| rc_AA410383_at | 277 | AA410383 | B-cell-homing chemokine (ligand for Burkitt's lymphoma receptor-1) | 7.5 | −3.95 |
| rc_AA131322_s_at | 74 | AA131322 | tryptase, alpha,tryptase, beta (tryptase II) | 7.2 | −2.81 |
| R56183_s_at | 844 | R56183 | eukaryotic translation initiation factor 3, subunit 6 (48 kD) | 6.9 | −2.77 |
| rc_AA461300_at | 381 | AA461300 | ESTs | 6.9 | −7.08 |
| J00231_f_at | 617 | J00231 | immunoglobulin heavy constant gamma 3 (G3m marker) | 6.7 | −4.62 |
| rc_AA427622_s_at | 311 | AA427622 | collagen, type XIII, alpha 1 | 6.6 | −8.25 |
| rc_T90889_at | 927 | T90889 | ESTs | 5.6 | −3.72 |
| rc_AA402903_f_at | 263 | AA402903 | immunoglobulin heavy constant gamma 3 (G3m marker) | 5.6 | −3.61 |
| rc_T23622_at | 886 | T23622 | ESTs | 5.5 | −5.24 |
| rc_T62857_at | 903 | T62857 | ESTs | 5.4 | −7.85 |
| rc_AA256268_at | 175 | AA256268 | ESTs | 5.3 | −6.86 |
| rc_R44714_s_at | 837 | R44714 | ESTs | 5.3 | −4.83 |
| rc_AA236476_at | 154 | AA236476 | transmembrane protein TENB2, | 5.1 | −3.13 |
| rc_AA028092_s_at | 17 | AA028092 | transcription factor 21 | 5.1 | −5.24 |
| rc_T90619_f_at | 926 | T90619 | actin, gamma 1 | 5.0 | −2.19 |
| J00123_at | 616 | J00123 | proenkephalin | 5.0 | −3.96 |
| X52541_at | 1064 | X52541 | early growth response 1 | 4.9 | −5.78 |
| rc_AA620825_at | 454 | AA620825 | CGI-43 protein | 4.9 | −4.59 |
| rc_AA424530_s_at | 304 | AA424530 | ESTs | 4.9 | −5.42 |
| rc_AA386386_s_at | 246 | AA386386 | procollagen-proline, 2-oxoglutarate 4-dioxygenase (proline 4-hydroxylase), beta polypeptide (protein disulfide isomerase; thyroid hormone binding protein p55) | 4.9 | −2.64 |
| U62015_at | 978 | U62015 | cysteine-rich, angiogenic inducer, 61 | 4.9 | −6.24 |
| rc_AA188981_at | 112 | AA188981 | highly expressed in cancer, rich in leucine heptad repeats | 4.9 | −6.67 |
| rc_H21814_f_at | 563 | H21814 | immunoglobulin lambda locus | 4.9 | −2.67 |
| M60314_at | 692 | M60314 | bone morphogenetic protein 5 | 4.7 | −10.82 |
| rc_T67053_f_at | 909 | T67053 | immunoglobulin lambda locus | 4.7 | −2.84 |
| rc_N47686_s_at | 744 | N47686 | solute carrier family 14 (urea transporter), member 1 (Kidd blood group) | 4.7 | −3.27 |
| rc_AA436616_at | 335 | AA436616 | ESTs | 4.7 | −6.34 |
| rc_H60595_s_at | 585 | H60595 | progesterone binding protein | 4.7 | −2.66 |
| rc_H88338_at | 601 | H88338 | ESTs | 4.7 | −7.93 |
| M33653_at | 682 | M33653 | collagen, type XIII, alpha 1 | 4.6 | −8.95 |
| rc_N30198_at | 733 | N30198 | ESTs | 4.5 | −5.87 |
| D83018_at | 513 | D83018 | nel (chicken)-like 2 | 4.5 | −9.79 |
| rc_Z39904_at | 1111 | Z39904 | ESTs | 4.5 | −6.27 |
| H61295_s_at | 586 | H61295 | CD4 antigen (p55) | 4.4 | −4.49 |
| rc_AA281345_f_at | 201 | AA281345 | immediate early protein | 4.3 | −6.62 |
| rc_T23490_s_at | 885 | T23490 | hypothetical protein FLJ20185 | 4.2 | −5.25 |
| rc_AA279760_at | 193 | AA279760 | DKFZP564M182 protein | 4.2 | −3.73 |
| rc_R25410_at | 814 | R25410 | ESTs | 4.2 | −4.69 |
| rc_T03229_f_at | 874 | T03229 | ESTs | 4.2 | −3.37 |
| rc_R93908_at | 865 | R93908 | ESTs | 4.2 | −3.39 |
| AA374109_at | 241 | AA374109 | spondin 2, extracellular matrix protein | 4.2 | −1.97 |
| rc_R45654_at | 838 | R45654 | collagen, type XIII, alpha 1 | 4.2 | −5.69 |
| rc_H86112_f_at | 600 | H86112 | KIAA0471 gene product | 4.1 | −4.00 |
| rc_AA257093_r_at | 178 | AA257093 | T cell receptor beta locus | 4.1 | −7.77 |
| rc_AA456147_at | 371 | AA456147 | general transcription factor IIIA | 4.1 | −6.23 |
| U21128_at | 953 | U21128 | lumican | 4.1 | −6.15 |
| rc_AA057195_at | 47 | AA057195 | TNF? elastin microfibril interface located protein | 4.1 | −2.22 |
| M63438_s_at | 696 | M63438 | immunoglobulin kappa variable 1D-8 | 4.0 | −2.53 |
| M57466_s_at | 690 | M57466 | major histocompatibility complex, class II, DP beta 1 | 4.0 | −3.91 |
| rc_AA443923_at | 344 | AA443923 | cat eye syndrome critical region gene 1 | 4.0 | −3.01 |
| rc_N39415_at | 742 | N39415 | DKFZP586P2421 protein | 4.0 | −5.70 |
| rc_W67225_at | 1021 | W67225 | KIAA0592 protein | 4.0 | −3.35 |
| M62831_at | 695 | M62831 | immediate early protein | 4.0 | −6.39 |
| rc_AA404957_at | 266 | AA404957 | matrix Gla protein | 4.0 | −3.84 |
| rc_F02992_at | 526 | F02992 | ESTs | 4.0 | −3.65 |
| U69263_at | 982 | U69263 | matrilin 2 | 3.9 | −4.84 |
| rc_AA448625_at | 354 | AA448625 | slit (Drosophila) homolog 3 | 3.9 | −4.13 |
| X57025_at | 1066 | X57025 | insulin-like growth factor 1 (somatomedin C) | 3.9 | −3.93 |
| AA151544_at | 91 | AA151544 | matrix metalloproteinase 23B | 3.8 | −5.54 |
| rc_F13763_at | 542 | F13763 | ESTs | 3.8 | −6.39 |
| rc_AA436655_at | 337 | AA436655 | hypothetical protein FLJ10781 | 3.8 | −5.13 |

TABLE 3-continued

Normal vs. BPH W/Symptoms (Up-regulated)

| Affymetrix element | SEQ ID NO: | GenBank ID | GenBank Name | Fold-change | t |
|---|---|---|---|---|---|
| M87789_s_at | 704 | M87789 | immunoglobulin heavy constant gamma 3 (G3m marker) | 3.8 | −3.93 |
| L44416_at | 647 | L44416 | DEAD/H (Asp-Glu-Ala-Asp/His) box polypeptide 17 (72 kD) | 3.8 | −1.75 |
| U20350_at | 951 | U20350 | chemokine (C-X3-C) receptor 1 | 3.8 | −6.50 |
| rc_AA449749_at | 355 | AA449749 | ESTs | 3.8 | −4.52 |
| rc_W73790_f_at | 1027 | W73790 | immunoglobulin lambda-like polypeptide 1 | 3.7 | −2.95 |
| rc_AA281145_at | 200 | AA281145 | ESTs | 3.7 | −1.77 |
| rc_F09748_s_at | 536 | F09748 | ESTs | 3.7 | −4.12 |
| rc_T64211_at | 906 | T64211 | HNOEL-iso protein | 3.7 | −5.35 |
| rc_N80152_at | 786 | N80152 | RNA binding motif protein 6 | 3.7 | −2.40 |
| rc_AA436618_at | 336 | AA436618 | microtubule-associated protein 2 | 3.7 | −4.67 |
| T85532_f_at | 917 | T85532 | ESTs | 3.7 | −1.90 |
| rc_AA398280_at | 248 | AA398280 | ESTs | 3.6 | −3.11 |
| rc_T23468_at | 884 | T23468 | CGI-119 protein | 3.6 | −4.67 |
| AA195678_at | 117 | AA195678 | actin binding protein; macrophin (microfilament and actin filament cross-linker protein) | 3.6 | −3.48 |
| AB002335_at | 460 | AB002335 | KIAA0337 gene product | 3.6 | −4.21 |
| rc_AA598982_s_at | 429 | AA598982 | KIAA1114 protein trophinin | 3.6 | −4.58 |
| J03507_at | 621 | J03507 | complement component 7 | 3.6 | −6.21 |
| J04130_s_at | 625 | J04130 | small inducible cytokine A4 (homologous to mouse Mip-1b) | 3.5 | −4.76 |
| AA495865_at | 421 | AA495865 | ESTs | 3.5 | −3.65 |
| HG3543-HT3739_at | | HG3543-HT3739 | insulin-like growth factor 2 (somatomedin A) | 3.5 | −4.69 |
| rc_AA599662_s_at | 439 | AA599662 | KIAA0534 protein | 3.5 | −4.32 |
| rc_AA486072_i_at | 410 | AA486072 | small inducible cytokine A5 (RANTES) | 3.5 | −3.88 |
| rc_Z39983_s_at | 1112 | Z39983 | KIAA0561 protein | 3.5 | −5.56 |
| rc_F02333_at | 523 | F02333 | hypothetical protein FLJ20093 | 3.5 | −2.23 |
| rc_AA151210_at | 89 | AA151210 | ESTs | 3.5 | −4.20 |
| rc_N92239_at | 793 | N92239 | Wnt inhibitory factor-1 | 3.5 | −3.06 |
| rc_AA173223_at | 108 | AA173223 | ESTs | 3.5 | −5.22 |
| rc_T86148_s_at | 919 | T86148 | pituitary tumor-transforming 1 interacting protein | 3.5 | −2.15 |
| AA214688_at | 129 | AA214688 | eukaryotic translation initiation factor 4B | 3.5 | −3.13 |
| rc_AA216589_at | 131 | AA216589 | ESTs | 3.5 | −4.40 |
| rc_AA446661_at | 347 | AA446661 | hypothetical protein FLJ10970 | 3.4 | −3.69 |
| AA082546_at | 54 | AA082546 | ESTs | 3.4 | −4.12 |
| rc_W46395_at | 1009 | W46395 | chromobox homolog 6 | 3.4 | −2.41 |
| rc_AA401433_at | 257 | AA401433 | ESTs | 3.4 | −3.17 |
| D62965_at | 502 | D62965 | ESTs | 3.4 | −2.07 |
| rc_AA057829_s_at | 48 | AA057829 | growth arrest-specific 6 | 3.4 | −2.00 |
| rc_AA009755_at | 6 | AA009755 | ESTs | 3.3 | −4.77 |
| AA247204_at | 163 | AA247204 | DEAD/H (Asp-Glu-Ala-Asp/His) box polypeptide 16 | 3.3 | −2.85 |
| D13628_at | 476 | D13628 | angiopoietin 1 | 3.3 | −4.86 |
| rc_N59866_at | 761 | N59866 | ESTs | 3.3 | −4.39 |
| rc_AA406371_at | 273 | AA406371 | ESTs | 3.3 | −4.98 |
| rc_N67876_s_at | 773 | N67876 | insulin-like growth factor 1 (somatomedin C) | 3.3 | −3.06 |
| M84526_at | 703 | M84526 | D component of complement (adipsin) | 3.3 | −3.06 |
| rc_AA234095_at | 144 | AA234095 | hypothetical protein FLJ20701 | 3.3 | −3.78 |
| rc_D60074_s_at | 498 | D60074 | cadherin 10 (T2-cadherin) | 3.3 | −5.05 |
| rc_T49602_s_at | 896 | T49602 | ESTs | 3.3 | −3.36 |
| rc_n22006_s_at | 718 | N22006 | ESTs | 3.3 | −3.88 |
| rc_F04112_f_at | 530 | F04112 | ESTs | 3.3 | −3.26 |
| rc_T64223_s_at | 907 | T64223 | carboxypeptidase A3 (mast cell) | 3.3 | −2.97 |
| U23946_at | 955 | U23946 | RNA binding motif protein 5 | 3.2 | −3.48 |
| rc_AA358038_at | 238 | AA358038 | SH3-binding domain glutamic add-rich protein like | 3.2 | −3.21 |
| rc_AA019433_at | 12 | AA019433 | ESTs | 3.2 | −3.88 |
| X03689_s_at | 1044 | X03689 | eukaryotic translation elongation factor 1 alpha 1 | 3.2 | −1.91 |
| rc_H17550_at | 559 | H17550 | ESTs | 3.2 | −2.90 |
| rc_AA047880_at | 38 | AA047880 | prothymosin, alpha (gene sequence 28) | 3.2 | −5.88 |
| rc_AA084138_at | 55 | AA084138 | ESTs | 3.2 | −7.93 |
| rc_AA599365_at | 434 | AA599365 | decorin | 3.2 | −4.42 |
| rc_N91971_f_at | 791 | N91971 | retinol-binding protein 1, cellular | 3.2 | −4.13 |
| rc_T62873_at | 904 | T62873 | ESTs | 3.2 | −2.12 |
| rc_N49899_at | 746 | N49899 | ESTs | 3.2 | −3.73 |
| AA298981_at | 226 | AA298981 | fibulin 5 | 3.2 | −6.06 |
| rc_AA479286_at | 403 | AA479286 | ESTs | 3.2 | −3.54 |
| J04111_at | 624 | J04111 | v-jun avian sarcoma virus 17 oncogene homolog | 3.2 | −5.47 |
| rc_AA465491_at | 391 | AA465491 | Mad4 homolog | 3.2 | −2.75 |
| W28548_at | 997 | W28548 | ESTs | 3.2 | −3.59 |
| AA308998_at | 227 | AA308998 | endothelial differentiation-related factor 1 | 3.2 | −2.89 |
| rc_AA488432_at | 412 | AA488432 | phosphoserine phosphatase | 3.2 | −3.48 |

TABLE 3-continued

Normal vs. BPH W/Symptoms (Up-regulated)

| Affymetrix element | SEQ ID NO: | GenBank ID | GenBank Name | Fold-change | t |
|---|---|---|---|---|---|
| rc_AA598991_at | 430 | AA598991 | amyloid beta (A4) precursor protein-binding, family A, member 2 (X11-like) | 3.1 | −4.51 |
| AA463311_at | 384 | AA463311 | hypothetical protein similar to mouse Fbw5 | 3.1 | −2.57 |
| rc_AA147224_at | 85 | AA147224 | ESTs | 3.1 | −4.41 |
| rc_AA609504_at | 444 | AA609504 | fibronectin leucine rich transmembrane protein 2 | 3.1 | −3.81 |
| U20734_s_at | 952 | U20734 | jun B proto-oncogene | 3.1 | −3.37 |
| U06863_at | 941 | U06863 | follistatin-like 1 | 3.1 | −2.48 |
| W51743_at | 1011 | W51743 | ESTs | 3.1 | −2.95 |
| rc_AA465093_at | 389 | AA465093 | TIA1 cytotoxic granule-associated RNA-binding protein | 3.1 | −5.34 |
| rc_AA219100_at | 132 | AA219100 | DKFZP586P2421 protein | 3.1 | −4.09 |
| rc_R42424_at | 832 | R42424 | ESTs | 3.1 | −3.82 |
| rc_W73038_at | 1026 | W73038 | ESTs | 3.1 | −2.23 |
| AA091278_at | 60 | AA091278 | hypothetical protein FLJ10793 | 3.1 | −2.75 |
| rc_AA620289_at | 451 | AA620289 | PRO0518 protein | 3.1 | −2.55 |
| rc_AA149579_at | 87 | AA149579 | prostate cancer associated protein 1 | 3.1 | −2.66 |
| M21121_at | 668 | M21121 | small inducible cytokine A5 (RANTES) | 3.1 | −4.97 |
| rc_AA427890_at | 312 | AA427890 | ESTs | 3.1 | −4.32 |
| M34516_r_at | 684 | M34516 | immunoglobulin lambda-like polypeptide 1 | 3.1 | −3.47 |
| rc_AA233347_at | 140 | AA233347 | zinc finger protein 216 | 3.1 | −2.43 |
| rc_W74533_at | 1029 | W74533 | latrophilin | 3.1 | −3.51 |
| rc_AA029597_at | 19 | AA029597 | bone morphogenetic protein 7 (osteogenic protein 1) | 3.1 | −3.80 |
| rc_N91887_s_at | 790 | N91887 | thymosin, beta, identified in neuroblastoma cells | 3.1 | −4.47 |
| rc_AA205724_at | 123 | AA205724 | ESTs | 3.0 | −6.70 |
| U30521_at | 960 | U30521 | P311 protein | 3.0 | −6.06 |
| X07109_at | 1052 | X07109 | protein kinase C, beta 1 | 3.0 | −4.90 |
| D82346_at | 511 | D82346 | potassium voltage-gated channel, KQT-like subfamily, member 2 | 3.0 | −3.49 |
| rc_AA478962_at | 400 | AA478962 | ESTs | 3.0 | −3.35 |
| rc_AA151428_s_at | 90 | AA151428 | matrix metalloproteinase 23A, matrix metalloproteinase 23B | 3.0 | −2.78 |
| rc_AA130349_at | 73 | AA130349 | ESTs | 3.0 | −2.01 |
| M18737_rna1_at | 661 | M18737 | granzyme A (granzyme 1, cytotoxic T-lymphocyte-associated serine esterase 3) | 3.0 | −5.90 |
| rc_N91461_at | 789 | N91461 | ESTs | 3.0 | −3.43 |
| rc_AA045481_at | 30 | AA045481 | ESTs | 3.0 | −3.70 |
| U91903_at | 989 | U91903 | frizzled-related protein | 3.0 | −4.73 |
| U19495_s_at | 950 | U19495 | stromal cell-derived factor 1 | 3.0 | −4.38 |
| M33493_s_at | 680 | M33493 | tryptase, alpha, tryptase, beta (tryptase II) | 3.0 | −3.12 |
| Y12711_at | 1103 | Y12711 | progesterone binding protein | 3.0 | −2.33 |
| rc_N58172_at | 757 | N58172 | ESTs | 3.0 | −2.53 |
| M12529_at | 655 | M12529 | apolipoprotein E | 3.0 | −1.92 |
| rc_AA412505_at | 288 | AA412505 | ESTs | 3.0 | −3.35 |
| U45955_at | 967 | U45955 | glycoprotein M6B | 3.0 | −4.09 |
| rc_H56673_at | 581 | H56673 | ESTs | 3.0 | −4.25 |
| L33799_at | 645 | L33799 | procollagen C-endopeptidase enhancer | 3.0 | −4.72 |
| rc_Z40186_at | 1114 | Z40186 | ESTs | 3.0 | −2.22 |
| AA094800_at | 64 | AA094800 | eukaryotic translation initiation factor 3, subunit 7 (zeta, 66/67 kD) | 2.9 | −2.56 |
| D21063_at | 480 | D21063 | minichromosome maintenance deficient (*S. cerevisiae*) 2 (mitotin) | 2.9 | −5.27 |
| rc_AA412049_at | 284 | AA412049 | ESTs | 2.9 | −2.63 |
| rc_AA599661_at | 438 | AA599661 | ESTs | 2.9 | −8.62 |
| L02870_s_at | 633 | L02870 | collagen, type VII, alpha 1 (epidermolysis bullosa, dystrophic, dominant and recessive) | 2.9 | −4.69 |
| rc_AA232266_s_at | 138 | AA232266 | ESTs | 2.9 | −3.22 |
| L02321_at | 631 | L02321 | glutathione S-transferase M5 | 2.9 | −3.33 |
| rc_AA428325_at | 315 | AA428325 | SEC14 (*S. cerevisiae*)-like 2 | 2.9 | −3.52 |
| D82534_at | 512 | D82534 | f-box and leucine-rich repeat protein 5 | 2.9 | −2.20 |
| rc_T32113_at | 889 | T32113 | KIAA0657 protein | 2.9 | −2.47 |
| rc_R10896_at | 808 | R10896 | cytochrome c oxidase subunit VIIa polypeptide 2 like | 2.9 | −1.99 |
| rc_AA019034_i_at | 11 | AA019034 | ESTs | 2.9 | −4.40 |
| D28423_at | 485 | D28423 | ESTs | 2.9 | −2.31 |
| rc_AA609943_at | 449 | AA609943 | ESTs | 2.9 | −3.86 |
| W69302_at | 1023 | W69302 | ESTs | 2.9 | −2.68 |
| rc_H01824_f_at | 544 | H01824 | GATA-binding protein 2 | 2.9 | −3.82 |
| rc_T67105_s_at | 910 | T67105 | ESTs | 2.9 | −5.49 |
| rc_AA426372_s_at | 307 | AA426372 | H1 histone family, member X | 2.9 | −2.53 |
| rc_T98288_f_at | 933 | T98288 | ESTs | 2.9 | −2.66 |
| rc_N63047_at | 762 | N63047 | ESTs | 2.9 | −5.25 |

TABLE 3-continued

Normal vs. BPH W/Symptoms (Up-regulated)

| Affymetrix element | SEQ ID NO: | GenBank ID | GenBank Name | Fold-change | t |
|---|---|---|---|---|---|
| U57316_at | 974 | U57316 | GCN5 (general control of amino-acid synthesis, yeast, homolog)-like 2 | 2.9 | −3.59 |
| rc_AA219304_s_at | 133 | AA219304 | alpha-2-macroglobulin | 2.9 | −1.76 |

TABLE 4

Normal vs. BPH W/Symptoms Table (Down-regulated)

| Affymetrix element | SEQ ID NO: | GenBank ID | GenBank Name | Fold-change | t |
|---|---|---|---|---|---|
| rc_T40895_at | 892 | T40895 | protein tyrosine phosphatase type IVA, member 1 | 16.5 | 5.19 |
| rc_N80129_i_at | 785 | N80129 | metallothionein 1L | 12.6 | 3.54 |
| rc_AA460914_at | 380 | AA460914 | ESTs | 7.4 | 4.58 |
| rc_AA234996_s_at | 147 | AA234996 | cytochrome C oxidase subunit VIa polypeptide 2 | 7.2 | 4.10 |
| X66141_at | 1078 | X66141 | myosin, light polypeptide 2, regulatory, cardiac, slow | 6.6 | 3.80 |
| AA234634_f_at | 145 | AA234634 | CCAAT/enhancer binding protein (C/EBP), delta | 6.2 | 4.35 |
| rc_AA419011_at | 296 | AA419011 | prostate androgen-regulated transcript 1 | 6.1 | 3.87 |
| rc_N94303_at | 797 | N94303 | ESTs | 5.8 | 5.96 |
| M20543_at | 666 | M20543 | actin, alpha 1, skeletal muscle | 5.5 | 3.20 |
| rc_AA085943_s_at | 58 | AA085943 | troponin T1, skeletal, slow | 5.5 | 3.02 |
| X06825_at | 1050 | X06825 | tropomyosin 2 (beta) | 5.2 | 3.35 |
| AB000584_at | 459 | AB000584 | prostate differentiation factor | 5.1 | 3.80 |
| M19309_s_at | 665 | M19309 | troponin T1, skeletal, slow | 5.0 | 3.41 |
| rc_AA040433_at | 24 | AA040433 | DKFZP586N2124 protein | 5.0 | 2.62 |
| rc_N32748_at | 736 | N32748 | ESTs | 5.0 | 3.36 |
| rc_AA227926_at | 135 | AA227926 | ESTs | 4.8 | 5.39 |
| rc_AA457566_at | 375 | AA457566 | ESTs | 4.7 | 4.22 |
| rc_AA026641_s_at | 16 | AA026641 | secretory leukocyte protease inhibitor (antileukoproteinase) | 4.6 | 2.09 |
| rc_AA053424_at | 40 | AA053424 | serine/threonine protein kinase MASK | 4.5 | 4.16 |
| V00594_at | 992 | V00594 | metallothionein 2A | 4.5 | 3.71 |
| rc_R16983_at | 811 | R16983 | ESTs | 4.5 | 3.23 |
| U75272_s_at | 984 | U75272 | progastricsin (pepsinogen C) | 4.4 | 4.57 |
| rc_T94447_s_at | 928 | T94447 | cortical thymocyte receptor (X. laevis CTX) like | 4.4 | 3.50 |
| U08021_at | 942 | U08021 | nicotinamide N-methyltransferase | 4.4 | 2.41 |
| J03910_rna1_at | 622 | J03910 | metallothionein 1G | 4.3 | 2.79 |
| rc_AA236545_at | 156 | AA236545 | ESTs | 4.2 | 2.41 |
| rc_AA211443_at | 127 | AA211443 | ESTs | 4.2 | 4.49 |
| rc_AA398908_at | 251 | AA398908 | ESTs | 4.2 | 2.64 |
| X57129_at | 1067 | X57129 | H1 histone family, member 2 | 4.2 | 3.88 |
| M21665_s_at | 670 | M21665 | myosin, heavy polypeptide 7, cardiac muscle, beta | 4.1 | 3.61 |
| X65614_at | 1076 | X65614 | S100 calcium-binding protein P | 4.1 | 4.03 |
| rc_AA197112_r_at | 119 | AA197112 | putative nuclear protein | 4.1 | 3.07 |
| M99487_at | 716 | M99487 | folate hydrolase (prostate-specific membrane antigen) 1 | 4.0 | 2.65 |
| X04201_at | 1045 | X04201 | neurotrophic tyrosine kinase, receptor, type 1 | 3.9 | 2.87 |
| X05451_s_at | 1046 | X05451 | ESTs | 3.9 | 3.26 |
| rc_AA435720_i_at | 328 | AA435720 | tubulin, alpha 2 | 3.9 | 2.20 |
| rc_N92502_s_at | 794 | N92502 | ESTs | 3.8 | 3.11 |
| L77701_at | 651 | L77701 | COX17 (yeast) homolog, cytochrome c oxidase assembly protein | 3.8 | 3.97 |
| HG2157-HT2227_at | | HG2157-HT2227 | ESTs | 3.8 | 4.08 |
| X76717_at | 1087 | X76717 | metallothionein 1L | 3.8 | 5.82 |
| HG1067-HT1067_r_at | | HG1067-HT1067 | ESTs | 3.7 | 3.02 |
| rc_AA599331_at | 433 | AA599331 | CGI-119 protein, uncharacterized bone marrow protein BM039 | 3.6 | 4.90 |
| M20642_s_at | 667 | M20642 | ESTs | 3.6 | 3.48 |
| rc_AA055163_at | 44 | AA055163 | calsequestrin 2, cardiac muscle | 3.6 | 3.66 |
| rc_AA127946_at | 72 | AA127946 | DKFZP586B2022 protein | 3.6 | 4.40 |
| rc_AA022886_at | 14 | AA022886 | retinal degeneration B beta | 3.6 | 3.51 |
| rc_AA342337_at | 231 | AA342337 | ESTs | 3.5 | 2.57 |
| X02544_at | 1042 | X02544 | orosomucoid 1 | 3.5 | 1.92 |
| rc_T73433_s_at | 912 | T73433 | angiotensinogen | 3.5 | 3.10 |
| M21494_at | 669 | M21494 | creatine kinase, muscle | 3.4 | 2.46 |
| rc_AA488072_s_at | 411 | AA488072 | cardiac ankyrin repeat protein | 3.4 | 2.78 |

TABLE 4-continued

Normal vs. BPH W/Symptoms Table (Down-regulated)

| Affymetrix element | SEQ ID NO: | GenBank ID | GenBank Name | Fold-change | t |
|---|---|---|---|---|---|
| rc_AA293187_s_at | 223 | AA293187 | B-cell CLL/lymphoma 3 | 3.4 | 1.62 |
| rc_AA599522_r_at | 437 | AA599522 | squamous cell carcinoma antigen recognised by T cells | 3.4 | 3.03 |
| rc_AA405488_at | 268 | AA405488 | ESTs | 3.4 | 2.57 |
| rc_AA461453_at | 382 | AA461453 | calcium binding protein Cab45 precursor, | 3.4 | 3.10 |
| rc_AA609006_at | 440 | AA609006 | ESTs | 3.4 | 2.30 |
| rc_N24761_at | 725 | N24761 | TU12B1-TY protein | 3.4 | 3.89 |
| rc_AA432162_at | 324 | AA432162 | DKFZP586B2022 protein | 3.4 | 2.78 |
| X06256_at | 1047 | X06256 | integrin, alpha 5 (fibronectin receptor, alpha polypeptide) | 3.4 | 4.51 |
| rc_AA045825_at | 33 | AA045825 | ESTs | 3.3 | 3.90 |
| rc_AA478778_at | 399 | AA478778 | ESTs | 3.3 | 4.37 |
| rc_N80129_f_at | 785 | N80129 | metallothionein 1L | 3.2 | 3.60 |
| rc_AA182030_at | 110 | AA182030 | pyruvate dehydrogenase kinase, isoenzyme 4 | 3.2 | 3.72 |
| rc_AA102489_at | 67 | AA102489 | hypothetical protein FLJ10337 | 3.2 | 2.20 |
| rc_R46074_at | 840 | R46074 | transforming, acidic coiled-coil containing protein 2 | 3.2 | 3.38 |
| rc_AA599522_f_at | 437 | AA599522 | squamous cell carcinoma antigen recognised by T cells | 3.2 | 2.36 |
| rc_AA165313_at | 104 | AA165313 | ESTs | 3.2 | 2.76 |
| rc_AA429636_at | 319 | AA429636 | hexokinase 2 | 3.2 | 3.12 |
| rc_R71792_s_at | 855 | R71792 | thrombospondin 1 | 3.1 | 2.31 |
| U05861_at | 940 | U05861 | aldo-keto reductase family 1, member C1 (dihydrodiol dehydrogenase 1; 20-alpha (3-alpha)-hydroxysteroid dehydrogenase), aldo-keto reductase family 1, member C2 (dihydrodiol dehydrogenase 2; bile acid binding protein; 3-alpha hydroxysteroid dehydrogenase, type III) | 3.1 | 2.62 |
| rc_AA410311_at | 275 | AA410311 | ESTs | 3.1 | 3.52 |
| rc_AA505136_at | 426 | AA505136 | ESTs | 3.1 | 3.00 |
| rc_T68873_f_at | 911 | T68873 | metallothionein 1L | 3.0 | 3.18 |
| X00371_ma1_at | 1041 | X00371 | myoglobin | 3.0 | 2.18 |
| rc_AA099820_at | 65 | AA099820 | ESTs | 3.0 | 3.08 |
| rc_T90190_s_at | 925 | T90190 | H1 histone family, member 2 | 3.0 | 3.48 |
| rc_AA227936_f_at | 136 | AA227936 | parathymosin | 3.0 | 1.76 |
| X90568_at | 1092 | X90568 | titin | 3.0 | 2.83 |
| rc_AA004699_at | 1 | AA004699 | orphan G-protein coupled receptor | 3.0 | 2.23 |
| rc_F03969_at | 528 | F03969 | ESTs | 2.9 | 2.53 |
| X93036_at | 1093 | X93036 | FXYD domain-containing ion transport regulator 3 | 2.9 | 2.91 |
| rc_R91484_at | 863 | R91484 | ESTs | 2.9 | 6.43 |
| rc_AA025370_at | 15 | AA025370 | K1AA0872 protein | 2.9 | 2.87 |
| X51441_s_at | 1063 | X51441 | serum amyloid A1 | 2.9 | 1.78 |
| X64177_f_at | 1075 | X64177 | metallothionein 1H | 2.9 | 3.36 |
| rc_AA255480_at | 173 | AA255480 | ECSIT | 2.9 | 2.38 |
| rc_AA476944_at | 394 | AA476944 | ESTs | 2.8 | 4.26 |
| U78294_at | 985 | U78294 | arachidonate 15-lipoxygenase, second type | 2.8 | 1.82 |
| rc_AA045487_at | 31 | AA045487 | ESTs | 2.8 | 2.75 |
| rc_N74291_at | 779 | N74291 | ESTs | 2.8 | 1.88 |
| rc_N91973_at | 792 | N91973 | hypothetical protein, three prime repair exonuclease 1 | 2.8 | 1.97 |
| D81655_at | 510 | D81655 | ESTs | 2.8 | 1.89 |
| U53225_at | 971 | U53225 | sorting nexin 1 | 2.8 | 3.16 |
| rc_H77597_f_at | 594 | H77597 | metallothionein 1H | 2.8 | 2.98 |
| K02215_at | 628 | K02215 | angiotensinogen | 2.8 | 3.05 |
| rc_AA464728_s_at | 388 | AA464728 | ESTs | 2.7 | 3.80 |
| rc_W49708_at | 1010 | W49708 | ESTs | 2.7 | 3.52 |
| rc_AA453435_at | 364 | AA453435 | ESTs | 2.7 | 4.78 |
| rc_D11824_at | 474 | D11824 | ESTs | 2.7 | 3.70 |
| rc_T56281_f_at | 902 | T56281 | RNA helicase-related protein | 2.7 | 2.62 |
| rc_AA182882_at | 111 | AA182882 | titin-cap (telethonin) | 2.7 | 1.85 |
| rc_AA447522_at | 349 | AA447522 | ESTs | 2.7 | 3.27 |
| rc_N26904_at | 731 | N26904 | FK506 binding protein precursor | 2.7 | 3.21 |
| rc_AA131919_at | 75 | AA131919 | putative type II membrane protein | 2.7 | 4.15 |
| rc_R89840_at | 862 | R89840 | ESTs | 2.7 | 2.23 |
| rc_W31470_at | 998 | W31470 | thyroid hormone receptor-associated protein, 95-kD subunit | 2.7 | 2.85 |
| rc_W92207_at | 1036 | W92207 | ESTs | 2.7 | 4.07 |
| U96094_at | 990 | U96094 | sarcolipin | 2.7 | 2.23 |
| rc_W70131_at | 1024 | W70131 | ESTs | 2.7 | 3.64 |
| rc_AA435720_f_at | 328 | AA435720 | tubulin, alpha 2 | 2.7 | 1.98 |
| rc_AA284879_at | 212 | AA284879 | ESTs | 2.7 | 1.74 |
| rc_H22453_at | 564 | H22453 | ESTs | 2.7 | 4.20 |
| D14826_s_at | 478 | D14826 | cAMP responsive element modulator | 2.6 | 4.13 |

TABLE 4-continued

Normal vs. BPH W/Symptoms Table (Down-regulated)

| Affymetrix element | SEQ ID NO: | GenBank ID | GenBank Name | Fold-change | t |
|---|---|---|---|---|---|
| rc_N93798_at | 796 | N93798 | protein tyrosine phosphatase type IVA, member 3 | 2.6 | 3.12 |
| U41804_at | 965 | U41804 | putative T1/ST2 receptor binding protein | 2.6 | 4.37 |
| rc_W20486_f_at | 995 | W20486 | chromosome 21 open reading frame 56 | 2.6 | 2.74 |
| rc_AA055768_at | 45 | AA055768 | CGI-119 protein | 2.6 | 2.13 |
| rc_AA447977_s_at | 352 | AA447977 | ESTs | 2.6 | 3.22 |
| AA380393_at | 243 | AA380393 | SEC7 homolog | 2.6 | 2.29 |
| rc_N29568_at | 732 | N29568 | thyroid hormone receptor-associated protein, 150 kDa subunit | 2.6 | 2.46 |
| rc_AA426374_f_at | 308 | AA426374 | tubulin, alpha 2 | 2.6 | 3.20 |
| rc_H94471_at | 604 | H94471 | occludin | 2.6 | 2.19 |
| rc_AA252219_at | 169 | AA252219 | ESTs | 2.6 | 3.83 |
| rc_AA402000_at | 259 | AA402000 | ESTs | 2.6 | 2.29 |
| rc_Z38744_at | 1108 | Z38744 | putative gene product | 2.6 | 4.18 |
| AA045870_at | 34 | AA045870 | ESTs | 2.6 | 2.26 |
| rc_R38678_at | 823 | R38678 | ESTs | 2.6 | 4.16 |
| R39467_f_at | 826 | R39467 | NEU1 protein | 2.6 | 2.79 |
| AA455001_s_at | 368 | AA455001 | CGI-43 protein | 2.6 | 5.34 |
| rc_AA292328_at | 221 | AA292328 | activating transcription factor 5 | 2.6 | 2.88 |
| X57348_s_at | 1068 | X57348 | stratifin | 2.6 | 2.48 |
| rc_T95005_s_at | 929 | T95005 | ESTs | 2.5 | 3.30 |
| AA410355_at | 276 | AA410355 | ribosomal protein S6 kinase, 70 kD, polypeptide | 2.5 | 2.31 |
| AA036900_at | 21 | AA036900 | ESTs | 2.5 | 2.45 |
| rc_F02204_at | 521 | F02204 | BAI1-associated protein 2 | 2.5 | 2.26 |
| U26173_s_at | 958 | U26173 | nuclear factor, interleukin 3 regulated | 2.5 | 3.91 |
| rc_AA477767_at | 396 | AA477767 | ESTs | 2.5 | 3.17 |
| rc_AA504805_s_at | 424 | AA504805 | interferon stimulated gene (20 kD) | 2.5 | 3.79 |
| rc_R33627_i_at | 818 | R33627 | ESTs | 2.5 | 1.99 |
| rc_T40995_f_at | 893 | T40995 | alcohol dehydrogenase 3 (class I), gamma polypeptide | 2.5 | 2.15 |
| rc_R00144_at | 801 | R00144 | ESTs | 2.5 | 2.69 |
| U02020_at | 936 | U02020 | pre-B-cell colony-enhancing factor | 2.5 | 4.20 |
| rc_AA287832_at | 217 | AA287832 | ESTs | 2.5 | 3.80 |
| AA429539_f_at | 318 | AA429539 | hypothetical protein | 2.5 | 2.35 |
| rc_H05084_at | 547 | H05084 | GDP-mannose pyrophosphorylase B | 2.5 | 2.23 |
| rc_AA405616_at | 271 | AA405616 | ESTs | 2.5 | 3.33 |
| AA455381_at | 370 | AA455381 | aldehyde dehydrogenase 5 family, member A1 (succinate-semialdehyde dehydrogenase) | 2.4 | 2.60 |
| M13955_at | 658 | M13955 | keratin 7 | 2.4 | 2.22 |
| rc_AA180314_at | 109 | AA180314 | ESTs | 2.4 | 2.53 |
| M37984_rna1_at | 688 | M37984 | troponin C, slow | 2.4 | 2.10 |
| M61764_at | 694 | M61764 | tubulin, gamma 1 | 2.4 | 3.48 |
| rc_AA150920_at | 88 | AA150920 | KIAA0539 gene product | 2.4 | 4.11 |
| X65965_s_at | 1077 | X65965 | superoxide dismutase 2, mitochondrial | 2.4 | 2.37 |
| X93510_at | 1094 | X93510 | LIM domain protein | 2.4 | 2.39 |
| rc_N48056_s_at | 745 | N48056 | folate hydrolase (prostate-specific membrane antigen) 1 | 2.4 | 1.80 |
| rc_N26713_s_at | 729 | N26713 | ESTs | 2.4 | 3.87 |
| rc_AA282247_at | 204 | AA282247 | ESTs | 2.4 | 3.17 |
| rc_D80617_at | 508 | D80617 | KIAA0596 protein | 2.4 | 2.02 |
| rc_F02245_at | 522 | F02245 | monoamine oxidase A | 2.4 | 2.79 |
| rc_R58878_at | 847 | R58878 | ESTs | 2.4 | 2.80 |
| rc_W45531_at | 1007 | W45531 | ESTs | 2.4 | 4.17 |
| L25270_at | 644 | L25270 | SMC (mouse) homolog, X chromosome | 2.4 | 3.26 |
| rc_W88568_at | 1035 | W88568 | glycogenin 2 | 2.4 | 1.90 |
| rc_AA070752_s_at | 51 | AA070752 | insulin receptor substrate 1 | 2.4 | 2.87 |
| U24169_at | 956 | U24169 | JTV1 gene,hypothetical protein PRO0992 | 2.4 | 3.41 |
| rc_T15423_s_at | 878 | T15423 | 2',3'-cyclic nucleotide 3' phosphodiesterase | 2.4 | 1.71 |
| X78706_at | 1088 | X78706 | carnitine acetyltransferase | 2.4 | 3.51 |
| rc_T10695_i_at | 876 | T10695 | enigma (LIM domain protein) 2.4 | 1.52 | |
| rc_AA430388_at | 321 | AA430388 | HSPC160 protein | 2.4 | 5.04 |
| M68519_rna1_at | 699 | M68519 | surfactant, pulmonary-associated protein A1 | 2.4 | 3.89 |
| rc_AA421562_at | 300 | AA421562 | anterior gradient 2 (Xenepus aevis) homolog | 2.4 | 1.80 |
| rc_T97243_at | 931 | T97243 | prenyl protein protease RCE1 | 2.4 | 2.46 |
| rc_T15409_f_at | 877 | T15409 | ESTs | 2.3 | 3.76 |
| rc_T62918_at | 905 | T62918 | ESTs | 2.3 | 2.59 |
| rc_R15108_at | 810 | R15108 | ESTs | 2.3 | 2.74 |
| AA454908_s_at | 366 | AA454908 | KIAA0144 gene product | 2.3 | 2.77 |
| rc_N64683_at | 764 | N64683 | CGI-119 protein | 2.3 | 2.27 |
| rc_H99035_at | 612 | H99035 | ESTs | 2.3 | 4.34 |
| Y08374_rna1_at | 1100 | Y08374 | chitinase 3-like 1 (cartilage glycoprotein-39) | 2.3 | 2.94 |
| rc_AA236241_at | 150 | AA236241 | ESTs | 2.3 | 1.57 |
| U52969_at | 970 | U52969 | Purkinje cell protein 4 | 2.3 | 3.49 |
| rc_R11526_f_at | 809 | R11526 | parathymosin | 2.3 | 1.71 |

TABLE 4-continued

Normal vs. BPH W/Symptoms Table (Down-regulated)

| Affymetrix element | SEQ ID NO: | GenBank ID | GenBank Name | Fold-change | t |
|---|---|---|---|---|---|
| rc_T15850_f_at | 880 | T15850 | ESTs | 2.3 | 2.42 |
| HG2259-HT2348_s_at | | HG2259-HT2348 | tubulin, alpha 1 (testis specific), tubulin, alpha, ubiquitous | 2.3 | 2.91 |
| rc_H15143_s_at | 554 | H15143 | ortholog of rat pippin | 2.3 | 1.45 |
| rc_AA101767_at | 66 | AA101767 | ESTs | 2.3 | 3.52 |
| rc_AA193197_at | 116 | AA193197 | sarcomeric muscle protein | 2.3 | 1.98 |
| U03688_at | 938 | U03688 | cytochrome P450, subfamily I (dioxin-inducible), polypeptide 1 (glaucoma 3, primary infantile) | 2.3 | 2.97 |
| rc_R37774_at | 822 | R37774 | cytochrome P450 retinoid metabolizing protein | 2.3 | 4.11 |
| rc_H81413_f_at | 597 | H81413 | high-mobility group (nonhistone chromosomal) protein isoforms I and Y | 2.3 | 3.12 |
| X16354_at | 1060 | X16354 | carcinoembryonic antigen-related cell adhesion molecule 1 (biliary glycoprotein) | 2.3 | 2.54 |
| rc_AA457235_at | 373 | AA457235 | ESTs | 2.3 | 2.25 |
| D13643_at | 477 | D13643 | KIAA0018 gene product | 2.3 | 1.78 |
| rc_N30856_at | 734 | N30856 | solute carrier family 19 (thiamine transporter), member 2 | 2.3 | 3.45 |
| M26311_s_at | 673 | M26311 | S100 calcium-binding protein A9 (calgranulin B) | 2.3 | 2.37 |
| rc_Z40556_at | 1116 | Z40556 | CGI-96 protein | 2.3 | 2.39 |
| rc_N79070_at | 783 | N79070 | ESTs | 2.3 | 1.43 |
| Z69881_at | 1122 | Z69881 | ATPase, Ca++ transporting, ubiquitous | 2.3 | 3.87 |
| rc_D60755_s_at | 500 | D60755 | ESTs | 2.3 | 2.30 |
| rc_N94424_at | 798 | N94424 | retinoic acid receptor responder (tazarotene induced) 1 | 2.2 | 1.09 |

TABLE 5

| Up-regulated genes | | Down-regulated genes | |
|---|---|---|---|
| Cluster | Fragment Name | Cluster | Fragment Name |
| 1 | rc_AA256268_at | 1 | rc_AA227926_at |
| 1 | rc_AA188981_at | 1 | rc_AA398908_at |
| 1 | rc_AA173223_at | 1 | L77701_at |
| 1 | rc_AA216589_at | 1 | rc_AA599331_at |
| 1 | rc_AA234095_at | 1 | AA455001_s_at |
| 1 | rc_H17550_at | 3 | rc_AA022886_at |
| 1 | AA308998_at | 3 | rc_N24761_at |
| 1 | rc_AA488432_at | 3 | X06256_at |
| 1 | rc_AA427890_at | 4 | HG1067-HT1067_r_at |
| 1 | rc_N91887_s_at | 4 | rc_AA127946_at |
| 1 | rc_AA045481_at | 4 | rc_AA405488_at |
| 3 | rc_T23622_at | 5 | AA234634_f_at |
| 3 | rc_T23490_s_at | 5 | X65614_at |
| 3 | rc_AA620289_at | 5 | rc_T73433_s_at |
| 4 | rc_H05704_r_at | 5 | rc_R91484_at |
| 4 | rc_AA436616_at | 5 | rc_N93798_at |
| 4 | rc_AA456147_at | 6 | rc_N94303_at |
| 4 | rc_f09748_s_at, AA495865_at | 6 | AB000584_at |
| 4 | rc_AA598982_s_at | 6 | rc_AA410311_at |
| 4 | HG3543-HT3739 at | 6 | rc_F02245_at |
| 4 | rc_AA609504_at | 7 | rc_T40895_at |
| 5 | rc_AA028092_s_at | 7 | rc_N80129_i_at, X76717_at rc_N80129_f_at, rc_T68873_f_at |
| 5 | U62015_at | 7 | rc_N32748_at |
| 5 | rc_F13763_at | 7 | V00594_at |
| 5 | rc_AA205724_at | 7 | J03910_rna1_at |
| 5 | U30521_at | 7 | X57129_at, rc_T90190_s_at |
| 6 | X52541_at | 7 | rc_AA182030_at |
| 6 | rc_AA281345_f_at, M62831_at | 7 | rc_AA505136_at |
| 7 | rc_n22006_s_at | 7 | X64177_f_at, rc_H77597_f_at |
| 7 | rc_R42424_at | 7 | rc_AA101767_at |

TABLE 6

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| AA092215_at | 61 | AA092215 | potassium channel modulatory factor | 0.1086431 | 0.887604969 | 0.000105867 | 0.141381127 | 0.031099165 | 0.000775399 |
| AA122242_at | 70 | AA122242 | mannose-6-phosphatereceptor (cation dependant) | 7.49E-05 | 0.560180168 | 0.87992066 | 0.006231736 | 0.000301953 | 0.664273011 |
| AA122302_at | 71 | AA122302 | S164 protein | 0.430127474 | 0.003373118 | 0.068806262 | 0.000514723 | 0.328161735 | 1.48715E-05 |
| AA155958_at | 94 | AA155958 | fetal Alzheimer antigen | 0.096247016 | 0.007959573 | 0.170003368 | 8.36688E-05 | 0.782399153 | 0.000223021 |
| AA236286_at | 151 | AA236286 | DKFZP564A122 protein | 0.052450894 | 0.034104742 | 0.076032207 | 0.000262856 | 0.875443134 | 0.000444482 |
| AA248802_at | 165 | AA248802 | D component of complement (adipsin) | 0.000230259 | 0.38257085 | 0.842458286 | 0.026030678 | 0.000947368 | 0.500601376 |
| AA293544_at | 225 | AA293544 | | 7.0282E-05 | 0.203858328 | 0.178154822 | 5.9415E-06 | 0.012632481 | 0.019226603 |
| AA376488_at | 242 | AA376468 | transducin-like enhancer of split 1, homolog of Drosophila E(spl) | 0.405364589 | 0.000353844 | 0.537460601 | 0.006147013 | 0.169320077 | 7.97148E-05 |
| AA410925_at | 278 | AA410925 | | 0.870505598 | 1.09859E-05 | 0.106359333 | 4.33855E-05 | 0.168431987 | 0.003967521 |
| AA461618_s_at | 383 | AA461618 | 0.001614433 | 0.497688178 | 0.000768417 | 0.001055794 | 6.29856E-10 | 0.031759146 | 0.416397432 |
| C15965_at | 468 | C15965 | | 0.000459149 | 0.350724893 | 0.919693498 | 0.000138025 | 0.000627643 | 0.00098994 |
| D10537_s_at | 472 | D10537 | myelin protein zero (Charcot-Marie-Tooth neuropathy 1B) | 4.11477E-05 | 0.923679005 | 4.72641E-05 | 0.000899706 | 0.975645863 | |
| D25303_at | 482 | D25303 | integrin, alpha 9 | 0.00061935 | 0.196221991 | 0.000846365 | 0.108182462 | 0.935105808 | 0.124782864 |
| D26598_at | 483 | D26598 | proteasome (prosome, macropain) subunit, beta type, 3 | 0.000121781 | 0.02105211 | 8.45942E-05 | 0.326778603 | 0.933101073 | 0.291769938 |
| D31887_at | 489 | D31887 | K1AA0062 protein | 0.000123265 | 0.12578298 | 0.000676946 | 0.084742928 | 0.675822922 | 0.174766454 |
| D50532_at | 492 | D50532 | macrophage lectin 2 (calcium dependent) | 0.013806312 | 0.034992941 | 0.07897755 | 0.981647465 | 6.26998E-05 | 0.000487842 |
| D50550_at | 493 | D50550 | lethal giant larvae (Drosophila) homolog 1 | 3.10455E-05 | 0.029363545 | 4.06139E-05 | 0.169772872 | 0.955324091 | 0.186302331 |
| D64154_at | 503 | D64154 | cell membrane glycoprotein, 110000M(r) (surface antigen) | 1.68633E-05 | 0.000696104 | 5.08732-05 | 0.747380424 | 0.814285971 | 0.90759386 |
| D84294_at | 514 | D84294 | tetratricopeptide repeat domain 3 | 8.04076E-06 | 0.163620727 | 0.000752223 | 0.017501269 | 0.299205599 | 0.142785528 |
| D86976_at | 515 | D86976 | minor histocompatibility antigen HA-1 | 3.35538E-06 | 0.219311742 | 4.36833E-07 | 0.007209475 | 0.701246025 | 0.002499824 |
| D87258_at | 516 | D87258 | protease, serine, 11 (IGF binding) | 9.00737E-05 | 0.762310231 | 0.004565624 | 0.000386998 | 0.305696637 | 0.008038934 |
| D87292_at | 517 | D87292 | thiosulfate sulfurtransferase (rhodanese) | 0.000418719 | 0.000188241 | 0.000078154 | 0.222741306 | 0.648642702 | 0.412240863 |
| D87465_at | 518 | D87465 | KIAA0275 gene product | 7.37644E-05 | 0.826724125 | 0.000140053 | 0.000450807 | 0.882546967 | 0.000727958 |
| H19969_at | 562 | H19969 | | 0.005160656 | 7.47697E-07 | 6.71287E-07 | 0.0152142 | 0.039287107 | 0.535558762 |
| H61361_s_at | 587 | H61361 | immunoglobulin superfamily containing leucine-rich repeat | 4.92249E-05 | 0.834280925 | 5.95931E-05 | 0.001490555 | 0.966053313 | 0.001694157 |
| J00277_at | 618 | J00277 | v-Ha-ras Harvey rat sarcoma viral oncogene homolog | 0.035655118 | 0.055426457 | 0.009927846 | 0.000332747 | 0.650555821 | 6.72893E-05 |
| J04076_at | 623 | J04076 | early growth response 2 (Krox-20 (Drosophila) homolog) | 0.034912914 | 0.473833846 | 2.46869E-11 | 0.285997211 | 1.48067E-05 | 1.13903E-06 |
| J04605_at | 627 | J04605 | peptidase D | 0.000200727 | 0.006030981 | 0.000362209 | 0.648903631 | 0.885410388 | 0.742239283 |
| K03204_f_at | 630 | K03204 | proline-rich protein BstNI subfamily 1 | 0.283795673 | 0.000798814 | 0.913648897 | 0.019814734 | 0.26284107 | 0.000926711 |
| L02326_f_at | 632 | L02326 | | 0.105345943 | 0.659037818 | 6.62426E-05 | 0.076492051 | 0.0245672 | 0.000181614 |
| L05500_at | 635 | L05500 | adenylate cyclase 1 (brain) | 0.016699778 | 0.257619651 | 3.79921E-05 | 0.002077455 | 0.101519111 | 6.32745E-06 |
| L06797_s_at | 636 | L06797 | chemokine (C-X-C motif), receptor 4 (fusin) | 0.443118956 | 0.447152817 | 1.30523E-06 | 0.926525008 | 0.000111977 | 0.000981046 |
| L08246_at | 637 | L08246 | myeloid cell leukemia sequence 1 (BCL2-related) | 0.043208838 | 0.230033308 | 4.68128E-10 | 0.596833839 | 6.55684E-05 | 5.57731E-05 |
| L13740_at | 639 | L13740 | nuclear receptor subfamily 4, group A, member 1 | 0.791312753 | 0.872331125 | 8.60985E-05 | 0.70798804 | 7.00025E-05 | 0.001852799 |
| L13852_at | 640 | L13852 | ubiquitin-activating enzyme E1-like | 0.000578096 | 0.646204921 | 0.003882395 | 0.000950816 | 0.599103668 | 0.004460291 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| L19437_at | 641 | L19437 | transaldolase 1 | 0.008021968 | 0.22883538 | 0.001388037 | 0.000773689 | 0.604482478 | 0.000135454 |
| L34587_at | 646 | L34587 | transcription elongation factor B (SIII), polypeptide 1 (15 kD, elongin C) | 0.000178315 | 0.105125832 | 7.09176E-05 | 0.11839964 | 0.830767426 | 0.080296411 |
| L44497_at | 648 | L44497 | cyclic AMP phosphoprotein, 19 kD | 0.000816364 | 0.012044336 | 0.000161685 | 0.000380948 | 0.686659704 | 0.467540879 |
| L76200_at | 650 | L76200 | guanylate kinase 1 | 0.000841699 | 0.002396122 | 0.000888336 | 0.889388751 | 0.988638065 | 0.879528075 |
| M12959_s_at | 656 | M12959 | T cell receptor alpha locus | 3.02601E-08 | 0.817611534 | 3.24058E-08 | 1.14437E-05 | 0.990909384 | 1.1981E-05 |
| M13560_s_at | 657 | M13560 | CD74 antigen (invariant polypeptide of major histocompatibility complex, class II antigen-associated) | 0.01541788 | 0.255419127 | 4.82527E-06 | 0.001882075 | 0.041399052 | 9.73079E-07 |
| M14660_at | 659 | M14660 | | 1.95092E-06 | 0.823404837 | 0.009910008 | 0.000180501 | 0.038673415 | 0.053432817 |
| M16336_s_at | 660 | M16336 | CD2 antigen (p50), sheep red blood cell receptor | 0.000908965 | 0.444045616 | 0.000106508 | 0.042888317 | 0.596564762 | 0.01280799 |
| M19154_at | 663 | M19154 | transforming growth factor, beta 2 | 0.021033675 | 0.886661499 | 5.38416E-05 | 0.039706043 | 0.100571645 | 0.00047052 |
| M19283_at | 664 | M19283 | actin, gamma 1 | 0.009680549 | 0.975542421 | 1.35524E-05 | 0.029109597 | 0.094241798 | 0.000262549 |
| M21121_s_at | 668 | M21121 | small inducible cytokine A5 (RANTES) | 0.00011935 | 0.82444906 | 0.028900951 | 0.000639223 | 0.114726075 | 0.042253328 |
| M31776_s_at | 677 | M31776 | natriuretic peptide precursor B | 9.53305E-05 | 0.786764461 | 0.00132485 | 0.000453681 | 0.511730949 | 0.003376181 |
| M33552_at | 681 | M33552 | lymphocyte-specific protein 1 | 0.098325681 | 0.187562681 | 0.000373789 | 0.008253387 | 0.070738695 | 2.37353E-05 |
| M37766_at | 687 | M37766 | CD48 antigen (B-cell membrane protein) | 0.006750544 | 0.671986725 | 0.000173892 | 0.007796504 | 0.321364096 | 0.000414775 |
| M54927_at | 689 | M54927 | proteolipid protein (Pelizaeus-Merzbacher disease, spastic paraplegia 2, uncomplicated) | 0.0008203 | 0.071504547 | 0.000610665 | 0.292633338 | 0.938762949 | 0.26282367 |
| M59465_at | 691 | M59465 | tumor necrosis factor, alpha-induced protein 3 | 0.905275899 | 0.300604716 | 2.40334E-05 | 0.370512119 | 3.79139E-05 | 6.51796E-06 |
| M60459_at | 693 | M60459 | erythropoietin receptor | 5.33228E-07 | 0.001997812 | 2.00307E-06 | 0.229150396 | 0.804556624 | 0.324369463 |
| M73077_at | 701 | M73077 | glucocorticoid receptor DNA binding factor 1 | 4.33165E-05 | 0.026210722 | 7.3229E-05 | 0.205361352 | 0.906734945 | 0.244557908 |
| M89796_rna1_at | 705 | M89796 | membrane-spanning 4-domains, subfamily A, member 1 | 3.38097E-07 | 0.68414038 | 0.000659504 | 0.000116527 | 0.107834095 | 0.014565483 |
| M94077_at | 709 | M94077 | loricrin | 7.86788E-05 | 0.167396165 | 8.55841E-06 | 0.050135902 | 0.633682729 | 0.017465235 |
| M94547_at | 710 | M94547 | myosin light chain 2a | 0.000922884 | 0.001567598 | 0.000142192 | 0.778547965 | 0.641162082 | 0.898495047 |
| M95678_at | 712 | M95678 | phospholipase C, beta 2 | 2.65752E-06 | 0.741444839 | 0.00021566 | 0.000330645 | 0.344847831 | 0.005753116 |
| M96995_5_at | 713 | M96995 | growth factor receptor-bound protein 2 | 0.000451432 | 0.370687613 | 0.000417356 | 0.039514013 | 0.984237779 | 0.037882757 |
| M98447_rna1_at | 714 | M98447 | transglutaminase 1 (K polypeptide epidermal type I, protein-glutamine-gamma-glutamyltransferase) | 0.101078475 | 0.000501168 | 0.49866517 | 0.047778543 | 0.027993512 | 9.36193E-05 |
| N24990_a_at | 728 | N24990 | | 0.000594989 | 0.692375474 | 0.833157714 | 0.001206749 | 0.00054518 | 0.837698657 |
| R08720_at | 805 | R08720 | hypothetical protein FLJ22609 | 0.384088189 | 0.004709624 | 0.405658837 | 0.000582614 | 0.970613897 | 0.000656156 |
| R33301_at | 817 | R33301 | | 0.263328276 | 0.008898636 | 0.324726425 | 0.000573184 | 0.899017203 | 0.000860093 |
| R39394_at | 825 | R39394 | E1B-55 kDa-associated protein 5 | 0.000120098 | 0.168965093 | 0.159597216 | 5.8721E-06 | 0.020650662 | 0.012378795 |
| rc_AA004901_at | 2 | AA004901 | | 0.00013 | 0.114226367 | 0.899931127 | 2.58485E-06 | 0.000448774 | 0.104547963 |
| rc_AA005382_s_at | 3 | AA005382 | granzyme K (serine protease, granzyme 3; tryptase II) | 4.06793E-05 | 0.956799991 | 0.000100487 | 0.000772831 | 0.838991074 | 0.001451838 |
| rc_AA009615_at | 5 | AA009615 | | 7.69548E-05 | 0.013016412 | 0.000583037 | 0.366115762 | 0.625611179 | 0.63418041 |
| rc_AA010358_at | 7 | AA010358 | | 1.36211E-06 | 0.550401822 | 0.139053486 | 0.000570081 | 0.001477269 | 0.511053692 |
| rc_AA017547_r_at | 9 | AA017547 | hypothetical protein FLJ12387 similar to kinesin light chain | 0.989540408 | 0.214430361 | 0.000274727 | 0.228713943 | 0.000084071 | 2.44522E-05 |
| rc_AA018414_at | 10 | AA018414 | | 0.556560157 | 0.000998026 | 0.519992597 | 0.000261037 | 0.958086097 | 0.000217926 |
| rc_AA022615_at | 13 | AA022615 | RNA binding motif protein 9 | 0.000158793 | 0.509341291 | 0.263342589 | 0.000159018 | 0.011670476 | 0.117665916 |
| rc_AA037828_at | 22 | AA037828 | | 0.000583981 | 0.645542969 | 0.84290982 | 0.000955558 | 0.002108779 | 0.543978545 |
| rc_AA043196_at | 26 | AA043196 | SMC (mouse) homolog, X chromosome | 0.008527895 | 0.000983583 | 0.000257323 | 0.328438436 | 0.331116816 | 0.90061816 |
| rc_AA053267_at | 39 | AA053267 | | 0.000119181 | 0.288536772 | 0.388296579 | 2.42934E-05 | 0.00046271 | 0.082295734 |
| rc_AA053883_at | 41 | AA053883 | KIAA1023 protein | 4.95718E-05 | 0.962839667 | 0.16054889 | 0.000624096 | 0.01179586 | 0.225390364 |
| rc_AA054222_at | 42 | AA054222 | | 0.39176403 | 0.002571399 | 0.102566251 | 0.000307234 | 0.461555799 | 2.09152E-05 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_AA055081_at | 43 | AA055081 | chromosome 5 open reading frame 4 | 6.36828E-05 | 0.206434411 | 0.797911434 | 5.59851E-06 | 5.42681E-05 | 0.316914958 |
| rc_AA065173_at | 49 | AA065173 | | 2.526782E-07 | 0.570857861 | 0.058275966 | 0.000180212 | 0.001970189 | 0.302526217 |
| rc_AA069913_at | 50 | AA069913 | | 0.653765843 | 0.527765555 | 5.65709E-06 | 0.815416554 | 0.000104293 | 0.00152505 |
| rc_AA071558_at | 52 | AA071558 | | 0.168309619 | 0.418677904 | 0.000189452 | 0.054446269 | 0.025471654 | 0.000103274 |
| rc_AA082041_at | 53 | AA082041 | likely homolog of rat kinase 0-interacting substance of 220 kDa; KIAA1250 protein | 0.000143369 | 0.247732655 | 0.871515758 | 0.040056839 | 0.000552895 | 0.3290855 |
| rc_AA084324_at | 56 | AA084324 | KIAA1041 protein | 0.000226203 | 0.056433291 | 0.000687497 | 0.216607531 | 0.780835192 | 0.321404997 |
| rc_AA085608_at | 57 | AA085608 | tyrosine 3-monooxygenase/tryptophan 5-monooxygenase activation protein, eta polypeptide | 0.029391584 | 0.03435634 | 0.041546789 | 0.000120442 | 0.894217078 | 0.000192545 |
| rc_AA114858_at | 68 | AA114858 | | 0.000210292 | 0.155417252 | 0.994165585 | 8.636522-06 | 0.000449478 | 0.170373425 |
| rc_AA132239_at | 76 | AA132239 | zinc finger protein homologous to Zfp-36 in mouse | 0.012168107 | 5.56988E-05 | 4.55236E-05 | 0.074087524 | 0.13607788 | 0.631558319 |
| rc_AA132453_at | 77 | AA132453 | | 0.000489304 | 0.141814616 | 8.74406E-05 | 0.136343527 | 0.678807616 | 0.063921338 |
| rc_AA138864_at | 81 | AA138864 | CGI-147 protein | 0.000224205 | 0.630168118 | 4.90412-05 | 0.009114985 | 0.72551107 | 0.003549498 |
| rc_AA143190_s_at | 83 | AA143190 | hypothetical protein FLJ20343 | 5.31694E-05 | 0.028424427 | 0.000127165 | 0.209594394 | 0.842566905 | 0.279924929 |
| rc_AA143467_at | 84 | AA143467 | | 1.62361E-06 | 0.259338862 | 1.37865E-06 | 0.003657312 | 0.975267724 | 0.003351742 |
| rc_AA149051_at | 86 | AA149051 | KIAA0433 protein | 4.08493E-05 | 0.490333235 | 0.026825837 | 4.57567E-05 | 0.07318676 | 0.012248149 |
| rc_AA152408_at | 93 | AA152408 | | 2.97974E-05 | 0.362537361 | 0.455914763 | 1.36986E-05 | 0.001140199 | 0.13486533 |
| rc_AA156064_at | 95 | AA156064 | nudix (nucleoside diphosphate linked moiety X)-type motifs | 0.275270351 | 0.000333624 | 0.875633108 | 0.01111677 | 0.23661308 | 0.000347347 |
| rc_AA158132_at | 98 | AA158132 | | 0.004899515 | 0.643469716 | 4.65182E-07 | 0.057915819 | 0.034659352 | 0.000177571 |
| rc_AA165116_at | 101 | AA165116 | | 0.000334885 | 0.681603266 | 0.211571862 | 0.000813512 | 0.029042963 | 0.151679697 |
| rc_AA165231_at | 102 | AA165231 | NADH dehydrogenase (ubiquinone) Fe—S protein 6 (13 kD) (NADH-coenzyme Q reductase) | 0.002549485 | 0.173959444 | 0.254670513 | 0.000135147 | 8.0406E-05 | 0.719982481 |
| rc_AA169837_at | 105 | AA169837 | | 0.08971279 | 0.008766485 | 0.091371238 | 8.4903E-05 | 0.993409911 | 8.74977E-05 |
| rc_AA172188_at | 107 | AA172188 | protocadherin alpha 5 | 0.000667976 | 0.267150381 | 4.96881E-06 | 0.077589163 | 0.269599078 | 0.006273958 |
| rc_AA189015_at | 113 | AA189015 | aminolevulinate, delta-, synthase 2 (sideroblastic/hypochromic anemia) | 0.083660421 | 0.006384313 | 1.64695E-08 | 0.237580015 | 0.000203416 | 0.037803249 |
| rc_AA192553_at | 115 | AA192553 | uncoupling protein 3 (mitochondrial, proton carrier) | 0.10098208 | 0.00017981 | 0.933630822 | 0.02546947 | 0.102059527 | 0.000244309 |
| rc_AA196549_at | 118 | AA196549 | | 0.001049824 | 0.569766558 | 0.000482225 | 0.001065463 | 0.839463674 | 0.000559925 |
| rc_AA205072_at | 120 | AA205072 | KIAA0980 protein | 0.000335755 | 0.586934845 | 0.684865398 | 0.000455367 | 0.002552925 | 0.389985886 |
| rc_AA205460_at | 122 | AA205460 | | 0.000108573 | 0.165439416 | 0.84259483 | 5.28568E-06 | 0.000494762 | 0.134180366 |
| rc_AA205947_at | 124 | AA205947 | HHGP protein | 0.000271962 | 0.552878143 | 0.70583219 | 0.000318994 | 0.001963327 | 0.376568675 |
| rc_AA207103_at | 125 | AA207103 | amiloride-sensitive cation channel 2, neuronal | 2.05331E-05 | 0.045239142 | 0.642629872 | 0.10526525 | 0.000317921 | 0.124103707 |
| rc_AA211300_at | 126 | AA211300 | KIAA0627 protein; Drosophila "multiple asters" (Mast)-like homolog 2 | 0.000445798 | 0.287777463 | 0.006200387 | 0.000703498 | 0.918638362 | 0.000971608 |
| rc_AA211835_s_at | 128 | AA211835 | MHC class II transactivator | 0.001672055 | 0.122505424 | 0.000371358 | 4.15083E-05 | 0.669263582 | 8.76636E-06 |
| rc_AA215379_at | 130 | AA215379 | | 7.98828E-05 | 0.366787682 | 0.194666913 | 3.33447E-05 | 0.012005727 | 0.051632715 |
| rc_AA228020_at | 137 | AA228020 | splicing factor (CC1.3) | 0.00047128 | 0.328754864 | 0.940819016 | 0.000119264 | 0.001167483 | 0.317270472 |
| rc_AA233545_at | 141 | AA233545 | AD-003 protein | 0.004492717 | 0.655215048 | 2.53288E-07 | 0.052976799 | 0.028149978 | 0.000113193 |
| rc_AA233854_at | 142 | AA233854 | S-phase kinase-associated protein 2 (p45) | 3.79954E-05 | 0.744241299 | 0.538817385 | 0.001845337 | 0.000884538 | 0.84309443 |
| rc_AA233935_at | 143 | AA233935 | | 0.000608235 | 0.578078963 | 0.30216801 | 0.00070772 | 0.023016587 | 0.163665636 |
| rc_AA234631_at | 146 | AA234631 | KIAA0788 protein | 0.000575081 | 0.410892837 | 0.954178902 | 0.000257285 | 0.000897188 | 0.457935122 |
| rc_AA236453_at | 152 | AA236453 | | 0.036687413 | 0.061484767 | 0.023140149 | 0.000407818 | 0.863002571 | 0.000227528 |
| rc_AA236477_at | 155 | AA236477 | KIAA1559 protein | 0.000207423 | 0.453577644 | 0.288868663 | 0.000140775 | 0.011962605 | 0.1090363 |
| rc_AA236822_at | 157 | AA236822 | KIAA1097 protein | 0.008052957 | 0.439727961 | 0.000891185 | 0.003207259 | 0.5219673 | 0.00045036 |

TABLE 6-continued

BPH vs. Normal and Cancer

| Affymetrix Fragment Name | SEQ ID NO: | GenBank ID | GenBank Name | Normal vs. BPHWS | Normal vs. BPHNoS | Normal vs. Cancer | BPHWS vs. BPHNoS | BPHWS vs. Cancer | BPHNoS vs. Cancer |
|---|---|---|---|---|---|---|---|---|---|
| rc_AA237011_at | 158 | AA237011 | ATP-binding cassette, sub-family F (GCN20), member 1 | 0.000202964 | 0.000263744 | 1.87304E-06 | 0.678815593 | 0.318565402 | 0.645008985 |
| rc_AA237034_at | 159 | AA237034 | golgi SNAP receptor complex member 2 | 2.31824E-05 | 0.319635059 | 3.30639E-08 | 0.010320292 | 0.220104139 | 0.000272212 |
| rc_AA243416_s_at | 180 | AA243416 | hypothetical protein, expressed in osteoblast | 0.033376619 | 4.72108E-05 | 0.469143753 | 0.032420785 | 0.182985166 | 0.000942701 |
| rc_AA243698_at | 161 | AA243698 | potassium channel modulatory factor | 0.06151528 | 0.30249952 | 0.000486853 | 0.010884151 | 0.124764794 | 9.91149E-05 |
| rc_AA243763_at | 162 | AA243763 | | 0.050706904 | 0.01206437 | 0.11555761 | 5.40095E-05 | 0.71829242 | 0.000198301 |
| rc_AA253361_at | 172 | AA253361 | | 0.000564229 | 0.000110501 | 0.010769519 | 0.397832434 | 0.394174789 | 0.11120186 |
| rc_AA255966_at | 174 | AA255966 | | 0.0005512371 | 0.381782918 | 0.000368364 | 0.040324542 | 0.933794518 | 0.03373143 |
| rc_AA256486_at | 177 | AA256486 | CGI-141 protein | 0.053041853 | 0.519681482 | 0.000805238 | 0.025864118 | 0.179033095 | 0.000657368 |
| rc_AA258585_at | 180 | AA258585 | cadherin 19, type 2 | 8.77783E-08 | 0.000879695 | 3.84529E-06 | 0.0526509 | 0.488129443 | 0.183610463 |
| rc_AA258595_f_at | 181 | AA258595 | major histocompatibility complex, class II, DQ beta 1 | 0.056902737 | 0.411462581 | 1.12504E-05 | 0.017626477 | 0.018278908 | 8.86477E-06 |
| rc_AA262107_at | 183 | AA262107 | | 0.051109951 | 0.028221779 | 0.046925687 | 0.000190669 | 0.972441626 | 0.000168986 |
| rc_AA262349_at | 184 | AA262349 | hypothetical protein FLJ10628 | 0.023368538 | 0.075191389 | 0.000520191 | 0.000323092 | 0.25384504 | 4.28987E-06 |
| rc_AA262477_at | 185 | AA262477 | ribonuclease HI, large subunit | 0.843423091 | 0.000293418 | 0.145801246 | 0.000917609 | 0.233064808 | 0.023283635 |
| rc_AA262969_f_at | 186 | AA262969 | px19-like protein | 0.000697965 | 0.002321008 | 4.86461E-08 | 0.916139727 | 0.050019001 | 0.106622452 |
| rc_AA278757_at | 187 | AA278757 | KIAA1205 protein | 0.000807747 | 0.701913497 | 0.00019298 | 0.001603897 | 0.71959281 | 0.000521168 |
| rc_AA278887_at | 189 | AA278887 | | 4.77289E-05 | 0.000505266 | 0.002921534 | 0.966491221 | 0.300838621 | 0.386804461 |
| rc_AA279028_at | 190 | AA279028 | | 0.269683575 | 0.000110029 | 0.899242284 | 0.00515459 | 0.355782598 | 0.000309622 |
| rc_AA279774_at | 194 | AA279774 | | 0.028330552 | 0.004250917 | 0.09766388 | 4.84994E-06 | 0.610845854 | 3.70943E-05 |
| rc_AA279821_at | 195 | AA279821 | | 0.01541818 | 0.057056528 | 0.036000999 | 0.00012115 | 0.75748484 | 0.000352962 |
| rc_AA280297_at | 196 | AA280297 | | 0.000490401 | 0.069649547 | 0.030554618 | 4.43102E-05 | 0.537205763 | 0.000396218 |
| rc_AA280309_at | 197 | AA280309 | | 0.027919295 | 0.048777883 | 0.042451847 | 0.000197325 | 0.872357649 | 0.000341621 |
| rc_AA280617_at | 198 | AA280617 | | 0.020747951 | 0.100016813 | 0.006218315 | 0.000457645 | 0.687853962 | 0.000114895 |
| rc_AA282739_at | 205 | AA282739 | Ser/Arg-related nuclear matrix protein (plenty of prolines 101-like) | 0.006885251 | 0.224885918 | 0.001928329 | 0.000638964 | 0.705244944 | 0.000179491 |
| rc_AA283091_at | 206 | AA283091 | KIAA1219 protein | 0.000391955 | 0.950383286 | 0.000147487 | 0.003849943 | 0.812656175 | 0.001947884 |
| rc_AA283772_at | 207 | AA283772 | replication factor C (activator 1) 5 (36.5 kD) | 0.472125644 | 0.0004274231 | 0.126899001 | 0.00082772 | 0.443684418 | 5.94032E-05 |
| rc_AA283774_at | 208 | AA283774 | | 0.634799287 | 0.001085136 | 0.77445967 | 0.000408559 | 0.858121118 | 0.000730937 |
| rc_AA283907_at | 209 | AA283907 | DC12 protein | 0.702306606 | 0.426110345 | 0.000364953 | 0.278959611 | 0.000181185 | 0.027738884 |
| rc_AA284777_at | 211 | AA284777 | | 0.00028958 | 0.613024306 | 0.843581256 | 0.0004624 | 0.001148934 | 0.515630593 |
| rc_AA286862_at | 214 | AA286862 | WD repeat domain 6 | 0.006465478 | 0.770956466 | 3.90332E-06 | 0.047019059 | 0.072475744 | 0.000368843 |
| rc_AA287107_s_at | 215 | AA287107 | zinc finger protein ZNF140-like protein | 0.000557513 | 0.647966939 | 0.168481176 | 0.000931348 | 0.049075778 | 0.113081619 |
| rc_AA287870_s_at | 218 | AA287870 | lymphotoxin beta (TNF superfamily, member 3) | 0.042868875 | 0.904123896 | 4.72641E-06 | 0.071763173 | 0.015492602 | 8.72095E-05 |
| rc_AA291970_at | 220 | AA291970 | lectomedin-2 | 0.133517759 | 0.00116479 | 0.062658963 | 1.25187E-05 | 0.731829127 | 3.02794E-06 |
| rc_AA292533_at | 222 | AA292533 | putative Rab5-interacting protein | 8.63268E-05 | 0.143959708 | 1.94797E-06 | 0.062483153 | 0.429586131 | 0.010599279 |
| rc_AA342918_at | 232 | AA342918 | hypothetical protein FLJ22313 | 0.000298568 | 0.534426232 | 0.802167146 | 0.015864864 | 0.000243847 | 0.42047475 |
| rc_AA347578_at | 234 | AA347578 | tubulin, beta polypeptide | 0.056066605 | 0.067322154 | 0.053415125 | 0.000815763 | 0.984081099 | 0.000765743 |
| rc_AA348446_at | 235 | AA348446 | | 0.00081514 | 0.498461887 | 0.002492252 | 0.000590962 | 0.75904915 | 0.001541743 |
| rc_AA349417_at | 236 | AA349417 | | 0.333508877 | 4.09468E-05 | 0.860387174 | 0.001709823 | 0.452900772 | 0.000147762 |
| rc_AA370867_at | 239 | AA370867 | | 0.000438073 | 0.000509149 | 0.076534621 | 0.678852203 | 0.097859647 | 0.062063558 |
| rc_AA371520_at | 240 | AA371520 | | 0.000956188 | 0.182406672 | 0.0004497 | 0.142299266 | 0.84509761 | 0.101288353 |
| rc_AA398719_at | 249 | AA398719 | homolog of rat nadrin | 0.005171893 | 0.312848506 | 0.003453438 | 0.000980065 | 0.903295813 | 0.000667115 |
| rc_AA399101_at | 252 | AA399101 | | 0.020406213 | 0.066006562 | 0.01403951 | 0.000219359 | 0.896140692 | 0.00013891 |
| rc_AA399542_f_at | 254 | AA399542 | | 0.225479535 | 0.502403493 | 5.62157E-05 | 0.098347881 | 0.007549959 | 6.44137E-05 |
| rc_AA400034_at | 255 | AA400034 | | 0.250995551 | 0.01453561 | 0.033099094 | 0.00095651 | 0.35107658 | 3.77436E-05 |

TABLE 6-continued

BPH vs. Normal and Cancer

| Affymetrix Fragment Name | SEQ ID NO: | GenBank ID | GenBank Name | P-Values | | | | |
|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_AA401297_s_at | 256 | AA401297 | symplekin; Huntingtin interacting protein I | 0.012585329 | 0.166831042 | 0.004370096 | 0.000663018 | 0.73639502 | 0.000215874 |
| rc_AA402468_at | 261 | AA402468 | | 0.099732216 | 9.36987E-05 | 0.673315411 | 0.017152495 | 0.245352826 | 0.000668187 |
| rc_AA402473_at | 262 | AA402473 | | 0.457960224 | 0.000426525 | 0.079152517 | 6.26915E-05 | 0.336346183 | 1.26194E-06 |
| rc_AA405331_at | 267 | AA405331 | golgi autoantigen, golgin subfamily a, 5 | 0.586184325 | 0.001885183 | 0.429082537 | 0.000584353 | 0.815182938 | 0.00026866 |
| rc_AA405533_at | 269 | AA405533 | integral membrane protein 2B | 0.000172614 | 0.497994468 | 0.082141472 | 0.000159183 | 0.055604922 | 0.0359498 |
| rc_AA405902_at | 272 | AA405902 | | 0.086820061 | 0.039035914 | 0.014052865 | 0.000655228 | 0.480598833 | 5.66656E-05 |
| rc_AA410954_at | 279 | AA410954 | | 1.16178E-05 | 1.50623E-06 | 1.03048E-05 | 0.330330235 | 0.980294091 | 0.341205824 |
| rc_AA411897_at | 281 | AA411897 | | 0.508186682 | 0.001994491 | 0.445499823 | 0.00043102 | 0.923458644 | 0.000312647 |
| rc_AA412267_at | 286 | AA412267 | | 0.164103629 | 3.89169E-07 | 0.756068057 | 1.61111E-09 | 0.10637429 | 3.90003E-06 |
| rc_AA412443_at | 287 | AA412443 | | 0.364026646 | 0.005904843 | 0.355261504 | 0.000673161 | 0.987349969 | 0.000639721 |
| rc_AA417011_at | 292 | AA417011 | | 0.97881335 | 0.000103601 | 0.347607058 | 0.000209225 | 0.359543109 | 6.44615E-06 |
| rc_AA417348_at | 293 | AA417348 | | 0.011726682 | 0.000513628 | 0.000733098 | 0.214868351 | 0.416407972 | 0.597824364 |
| rc_AA417915_at | 294 | AA417915 | | 0.00031475 | 0.724609869 | 0.33434685 | 0.000849216 | 0.012345648 | 0.253561808 |
| rc_AA418557_at | 295 | AA418557 | | 0.228039568 | 0.580130356 | 0.000535144 | 0.124915173 | 0.032252409 | 0.000643742 |
| rc_AA421131_at | 298 | AA421131 | | 0.000944552 | 0.385647564 | 0.015545606 | 0.00033745 | 0.400009139 | 0.000441922 |
| rc_AA421133_at | 299 | AA421133 | erythrocyte transmembrane protein | 0.048370115 | 0.776945443 | 3.5594E-06 | 0.170573072 | 0.011573179 | 0.000337276 |
| rc_AA424037_s_at | 301 | AA424037 | | 0.004243716 | 0.739593135 | 2.30322E-05 | 0.006963992 | 0.192467998 | 0.000122214 |
| rc_AA424245_at | 302 | AA424245 | | 0.000912849 | 0.241386195 | 0.00608875 | 0.10233451 | 0.915105608 | 0.08414343 |
| rc_AA424515_at | 303 | AA424515 | | 0.001461647 | 0.327161944 | 0.557700471 | 0.000331758 | 0.000350136 | 0.650111174 |
| rc_AA425325_at | 305 | AA425325 | | 0.000137613 | 0.761000474 | 0.006888125 | 0.000531496 | 0.292230161 | 0.011066086 |
| rc_AA425354_at | 306 | AA425354 | | 1.135E-05 | 0.848812392 | 4.31696E-05 | 0.000125249 | 0.776028887 | 0.000335665 |
| rc_AA426438_at | 309 | AA426438 | tissue factor pathway inhibitor (lipoprotein-associated coagulation inhibitor) | 0.086215951 | 0.051460629 | 0.077775438 | 0.000971113 | 0.963651921 | 0.000841613 |
| rc_AA426454_s_at | 310 | AA426454 | imidazoline receptor candidate | 4.93792E-06 | 0.168883843 | 0.000430545 | 0.0131940440 | 0.320673843 | 0.1079437 |
| rc_AA427944_at | 313 | AA427944 | | 0.016580683 | 2.63482E-05 | 0.961128446 | 0.040898728 | 0.020386125 | 4.53083E-05 |
| rc_AA428243_at | 314 | AA428243 | integrin beta 4 binding protein | 0.000258966 | 0.030169371 | 0.000115376 | 0.338639919 | 0.847641147 | 0.260434676 |
| rc_AA428460_at | 316 | AA428460 | | 0.369406205 | 2.86818E-05 | 0.170103625 | 1.87552E-06 | 0.031318989 | 0.00400089 |
| rc_AA429398_s_at | 317 | AA429398 | | 0.042509423 | 0.318204908 | 0.000808205 | 0.00812556 | 0.209966492 | 0.000179435 |
| rc_AA430738_at | 322 | AA430738 | hypothetical protein FLJ22693 | 2.4223E-05 | 0.512347676 | 0.057495876 | 3.43792E-05 | 0.027579258 | 0.027106503 |
| rc_AA433922_at | 326 | AA433922 | NRAS-related gene | 0.000129534 | 0.750927276 | 0.024589837 | 0.000483913 | 0.13400345 | 0.02912486 |
| rc_AA435753_at | 329 | AA435753 | | 0.167368191 | 0.01678153 | 0.00563702 | 0.000567982 | 0.188083313 | 4.20658E-06 |
| rc_AA435852_at | 331 | AA435852 | hypothetical protein | 0.000178813 | 0.813799408 | 0.130706548 | 0.000825341 | 0.033909282 | 0.137866512 |
| rc_AA436244_at | 332 | AA436244 | dual specificity phosphatase 10 | 0.000347902 | 0.773066458 | 0.838936155 | 0.006955308 | 0.000335763 | 0.655473596 |
| rc_AA436489_at | 333 | AA436489 | | 0.089585972 | 0.000336423 | 0.55802583 | 0.042116461 | 0.02818715 | 7.58265E-05 |
| rc_AA436548_at | 334 | AA436548 | | 4.79946E-05 | 0.79712195 | 0.073989554 | 0.000284052 | 0.03065051 | 0.08299101 |
| rc_AA436823_at | 338 | AA436823 | | 3.43792E-06 | 0.007238466 | 0.000134014 | 0.199586541 | 0.434475995 | 0.550333062 |
| rc_AA436841_at | 339 | AA436841 | nuclear factor of kappa light polypeptide gene enhancer in B-cells inhibitor, beta | 0.000757034 | 0.109130693 | 3.14861E-05 | 0.206545207 | 0.451070087 | 0.054341855 |
| rc_AA437226_s_at | 341 | AA437226 | interleukin 10 receptor, alpha | 0.030634205 | 0.394007384 | 3.12463E-06 | 0.008853685 | 0.017676075 | 2.623E-06 |
| rc_AA442830_at | 342 | AA442830 | | 0.277387057 | 0.000957882 | 0.739163222 | 4.56542E-05 | 0.474861158 | 0.000560401 |
| rc_AA446899_at | 348 | AA446899 | mannosidase, alpha, class 1B, member 1 | 4.08376E-08 | 0.474845978 | 8.66417E-09 | 0.000104871 | 0.799444331 | 4.09828E-05 |
| rc_AA448228_at | 353 | AA448228 | HSPC142 protein | 0.489815716 | 0.427628808 | 0.00011718 | 0.181303904 | 1.63664E-05 | 0.014570459 |
| rc_AA450073_s_at | 357 | AA450073 | | 0.070060208 | 0.424331633 | 0.00057893 | 0.02291416 | 0.12207024 | 0.000282414 |
| rc_AA450373_at | 361 | AA450373 | paired mesoderm homeo box 1 | 0.19184076 | 0.000421707 | 3.75092E-05 | 0.021344923 | 0.007526828 | 0.966348045 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_AA454016_at | 365 | AA454016 | | 0.74223808 | 0.000765848 | 0.794392558 | 0.003084476 | 0.573990681 | 0.000561238 |
| rc_AA454928_at | 367 | AA454928 | phosphorylase kinase, beta | 0.042150436 | 0.023733581 | 0.157838834 | 0.000111797 | 0.556629171 | 0.000814363 |
| rc_AA457148_at | 372 | AA457148 | | 0.770822781 | 0.643699605 | 7.37551E-05 | 0.492232725 | 0.000493842 | 0.000082201 |
| rc_AA457407_at | 374 | AA457407 | transmembrane protease, serine 2 | 0.322389783 | 0.009487182 | 0.088848624 | 0.000914536 | 0.499415786 | 9.30818E-05 |
| rc_AA457675_at | 376 | AA457675 | | 0.000470812 | 0.007879992 | 0.000974653 | 0.721378015 | 0.850190113 | 0.848554875 |
| rc_AA459272_at | 377 | AA459272 | | 8.59013E-05 | 0.738889634 | 0.711426345 | 0.003207799 | 0.000073865 | 0.989771621 |
| rc_AA460377_at | 378 | AA460377 | beta-catenin-interacting protein ICAT | 0.015059101 | 0.036482503 | 0.009644184 | 5.52729E-05 | 0.881315511 | 3.13984E-05 |
| rc_AA464598_at | 387 | AA464598 | KIAA1389 protein | 0.000373603 | 0.650628457 | 0.000200085 | 0.000684765 | 0.878718031 | 0.000416438 |
| rc_AA469954_i_at | 392 | AA469954 | Arg/Abl-interacting protein ArgBP2 | 0.239197445 | 0.004848961 | 0.288136551 | 0.000228067 | 0.913292289 | 0.000330413 |
| rc_AA476594_i_at | 393 | AA476594 | | 0.358342961 | 0.881892103 | 0.000846963 | 0.534258655 | 5.41111E-05 | 0.003508506 |
| rc_AA477119_at | 395 | AA477119 | | 0.154425839 | 0.46185093 | 0.00021398 | 0.058896186 | 0.030447512 | 0.000152407 |
| rc_AA477833_at | 397 | AA477833 | translocase of inner mitochondrial membrane 44 (yeast) homolog | 0.019542745 | 0.5471713 | 3.40147E-05 | 0.011694366 | 0.085999006 | 5.64814E-05 |
| rc_AA478615_s_at | 398 | AA478615 | H1 histone family, member X | 0.640957846 | 0.0022057 | 0.208838599 | 0.000871626 | 0.453348417 | 6.70146E-05 |
| rc_AA478996_at | 401 | AA478996 | | 0.680984202 | 0.000380025 | 0.977809564 | 0.000172484 | 0.677109345 | 0.000696316 |
| rc_AA481057_f_at | 404 | AA481057 | | 0.029606002 | 0.060557911 | 0.05307758 | 0.000302603 | 0.819130316 | 0.000643675 |
| rc_aa482107_s_at | 406 | AA482107 | | 0.412141577 | 0.217724563 | 0.000197553 | 0.061952573 | 1.63874E-05 | 0.055779976 |
| rc_AA482559_at | 407 | AA482559 | RPA-binding transactivator | 0.010341566 | 0.960676267 | 3.22844E-05 | 0.02919031 | 0.130837801 | 0.000454944 |
| rc_AA485243_at | 408 | AA485243 | leptin receptor | 3.17405E-05 | 0.744743793 | 0.400224468 | 0.00016024 | 0.001638049 | 0.311163055 |
| rc_AA488658_at | 413 | AA488658 | hypothetical protein | 0.000418682 | 0.365249562 | 0.186392502 | 0.000141589 | 0.036308821 | 0.048918937 |
| rc_AA488849_at | 414 | AA488849 | nucleotide binding protein 2 (E.coli MinD like) | 0.17603882 | 0.323192094 | 0.000687853 | 0.037989302 | 0.052798072 | 0.000161003 |
| rc_AA489637_at | 415 | AA489637 | | 0.003960452 | 0.871859148 | 0.000107388 | 0.010699848 | 0.346672042 | 0.000730896 |
| rc_AA490120_at | 416 | AA490120 | | 0.082001486 | 0.454413511 | 0.000859271 | 0.03024764 | 0.130537834 | 0.000479561 |
| rc_AA490520_at | 418 | AA490520 | | 0.000063489 | 0.471991068 | 0.445872157 | 0.000410063 | 0.011810787 | 0.185068096 |
| rc_AA490999_at | 420 | AA490999 | | 0.001846648 | 0.670951196 | 0.000150658 | 0.002708195 | 0.521238606 | 0.000368557 |
| rc_AA504255_at | 423 | AA504255 | ataxia telangiectasia and Rad3 related | 0.000747725 | 1.58087E-05 | 0.446946913 | 0.053347131 | 0.001163384 | 1.74835E-06 |
| rc_AA505022_at | 425 | AA505022 | | 0.250524892 | 0.000259519 | 0.084574205 | 7.98938E-06 | 0.584980634 | 7.63588E-07 |
| rc_AA599376_at | 435 | AA599376 | | 0.015748126 | 0.140670046 | 0.009272938 | 0.000615583 | 0.859099543 | 0.000343134 |
| rc_AA599443_f_at | 436 | AA599443 | hypothetical protein FLJ10595 | 0.379179145 | 0.00382066 | 0.40828628 | 0.000446702 | 0.960279666 | 0.000525999 |
| rc_AA609657_at | 446 | AA609657 | | 7.04465E-05 | 0.091053447 | 0.00093271 | 0.092251403 | 0.5283101 | 0.25823308 |
| rc_AA609848_at | 447 | AA609848 | | 0.042723584 | 0.092999102 | 0.03617711 | 0.000967007 | 0.948113344 | 0.000787862 |
| rc_AA609869_at | 448 | AA609869 | hypothetical protein FLJ13222 | 4.47677E-05 | 0.00053907 | 2.12675E-07 | 0.943295205 | 0.293840522 | 0.321292026 |
| rc_AA610070_at | 450 | AA610070 | calcium/calmodulin-dependent serine protein kinase (MAGUK family) | 0.000126016 | 0.058243496 | 0.558814317 | 0.170494931 | 2.76548E-05 | 0.021111632 |
| rc_AA620806_at | 453 | AA620806 | ASB-3 protein | 4.7861E-06 | 0.710135071 | 0.298838834 | 0.000563366 | 0.000797621 | 0.611912234 |
| rc_AA621325_at | 455 | AA621325 | HNK-1 sulfotransferase | 0.000848661 | 0.346193012 | 0.004864951 | 0.000232221 | 0.621405553 | 0.001162331 |
| rc_C14898_at | 467 | C14898 | | 0.000226586 | 0.885711705 | 6.82551E-05 | 0.003389818 | 0.77964221 | 0.001496457 |
| rc_C20547_at | 469 | C20547 | | 0.068260402 | 0.000952953 | 0.812550962 | 2.71206E-06 | 0.13287942 | 0.000746928 |
| rc_C20658_at | 470 | C20658 | cisplatin resistance-associated overexpressed protein | 0.000322792 | 0.311886375 | 0.000285103 | 7.37384E-05 | 0.975640568 | 6.58868E-05 |
| rc_D11789_f_at | 473 | D11789 | | 0.21798848 | 0.000243771 | 0.79113972 | 0.012426673 | 0.155631425 | 0.000180292 |
| rc_D11961_at | 475 | D11961 | hypothetical protein FLJ21343 | 0.066999427 | 0.031322113 | 0.050959636 | 0.000327468 | 0.909256528 | 0.000222056 |
| rc_D20085_at | 479 | D20085 | | 0.533566658 | 0.000441315 | 0.321182892 | 0.004260671 | 0.125885439 | 2.65015E-05 |
| rc_D52692_s_at | 497 | D52692 | Ca2+-dependent activator protein for secretion | 1.02115E-06 | 0.807110908 | 1.27404E-05 | 0.000127062 | 0.619779281 | 0.000681487 |
| rc_D60272_i_at | 499 | D60272 | | 0.000665091 | 0.000166097 | 0.000151004 | 0.431868883 | 0.714339713 | 0.641956827 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_D80298_f_at | 507 | D80298 | | 0.045427886 | 0.000323207 | 0.958861584 | 0.073418502 | 0.064448036 | 0.000644976 |
| rc_D80738_f_at | 509 | D80738 | | 0.190797369 | 0.00173762 | 0.245104642 | 4.17807E-05 | 0.889912758 | 7.00818E-05 |
| rc_F01684_at | 519 | F01684 | | 0.420181016 | 0.000494834 | 0.488322276 | 5.87948E-05 | 0.914533384 | 8.72831E-05 |
| rc_F02739_at | 525 | F02739 | | 5.54856E-05 | 0.053527575 | 0.000291424 | 0.133799091 | 0.698411971 | 0.246269511 |
| rc_F04019_at | 529 | F04019 | | 0.000166861 | 0.000950517 | 0.555841593 | 0.965823573 | 0.00259065 | 0.007252422 |
| rc_F10193_at | 539 | F10193 | | 1.30777E-05 | 0.948962688 | 0.020624022 | 0.000363518 | 0.05248761 | 0.062247376 |
| rc_F10323_f_at | 540 | F10323 | chromosome 21 open reading frame 39 | 0.000650946 | 0.502771636 | 0.015425251 | 0.000500148 | 0.348990394 | 0.007831047 |
| rc_F10980_at | 541 | F10980 | retinoblastoma-like 2 (p130) | 8.9375E-05 | 0.653407439 | 0.012465868 | 0.000223205 | 0.178217348 | 0.012058063 |
| rc_H01068_at | 543 | H01068 | | 0.865173633 | 0.000069676 | 0.466764828 | 0.001528575 | 0.394999429 | 9.00281E-05 |
| rc_H09077_at | 551 | H09077 | | 3.06359E-05 | 1.2292E-05 | 0.021919052 | 0.46401342 | 0.07497746 | 0.021793621 |
| rc_H11463_at | 552 | H11463 | inhibitor of growth family, member 3 | 0.00061851 | 0.000440258 | 0.000113152 | 0.597222623 | 0.678354487 | 0.869200328 |
| rc_H14810_s_at | 553 | H14810 | popeye protein 3 | 1.36532E-05 | 0.832182578 | 0.004057496 | 0.000637115 | 0.161519166 | 0.02810637 |
| rc_H18099_at | 560 | H18099 | | 0.247088588 | 0.003400663 | 0.301565366 | 0.000158641 | 0.90607919 | 0.000239103 |
| rc_H23407_s_at | 565 | H23407 | MAD1 (mitotic arrest deficient, yeast, homolog)-like 1 | 0.000753122 | 0.112093793 | 2.71462E-05 | 0.201584279 | 0.432877141 | 0.049424886 |
| rc_H23520_at | 566 | H23520 | | 0.611355729 | 0.000871266 | 0.849483973 | 0.000293132 | 0.507906287 | 0.002361124 |
| rc_H38418_at | 570 | H38418 | | 0.185134143 | 0.065592241 | 0.00878561 | 0.50515013 | 0.000181804 | 7.8388E-05 |
| rc_H38995_f_at | 571 | H38995 | KIAA0471 gene product | 0.009631356 | 0.97045862 | 5.86902E-05 | 0.028854385 | 0.175136692 | 0.000728104 |
| rc_H45265_at | 574 | H45265 | ATP-binding cassette, sub-family A (ABC1), member 7 | 0.000152193 | 4.19671E-07 | 0.003258301 | 0.08727525 | 0.422648726 | 0.015812939 |
| rc_H48263_at | 575 | H48263 | | 0.185258234 | 0.007096561 | 0.191295818 | 0.00022522 | 0.986389253 | 0.000238835 |
| rc_H48475_at | 576 | H48475 | ribosomal protein L37a | 0.227463546 | 0.00062116 | 0.579381783 | 1.76941E-05 | 0.535824365 | 0.000177441 |
| rc_H58781_at | 582 | H58781 | hypothetical protein | 0.042650671 | 0.000369904 | 0.497627082 | 0.082860732 | 0.010272658 | 6.73936E-05 |
| rc_H59141_at | 584 | H59141 | | 0.001248184 | 4.64747E-07 | 0.066732688 | 0.031003204 | 0.185961631 | 0.000909745 |
| rc_H63994_at | 588 | H63994 | KIAA0618 gene product | 0.042052556 | 0.003078049 | 0.051932289 | 5.75286E-06 | 0.93248223 | 8.15902E-06 |
| rc_H64411_at | 589 | H64411 | HIR (histone cell cycle regulation defective, S. cerevisiae) homolog A | 0.01802462 | 0.070417348 | 0.012928934 | 0.000210449 | 0.908905166 | 0.000140956 |
| rc_H77531_s_at | 593 | H77531 | | 0.000791123 | 0.49434307 | 0.184056577 | 0.00056294 | 0.054421223 | 0.078090378 |
| rc_H97868_at | 608 | H97868 | | 0.322057918 | 0.489184724 | 0.000285548 | 0.136645099 | 0.012333089 | 0.000230315 |
| rc_H97889_at | 609 | H97889 | | 0.158642014 | 0.00916284 | 0.299358664 | 0.000236375 | 0.724266848 | 0.00075937 |
| rc_H98676_at | 610 | H98676 | | 0.127756769 | 0.002896791 | 0.262913685 | 3.64577E-05 | 0.701889069 | 0.000148754 |
| rc_N20967_at | 717 | N20967 | | 9.92879E-05 | 0.817666422 | 3.00688E-05 | 0.000539948 | 0.790070901 | 0.000221099 |
| rc_N22115_s_at | 720 | N22115 | KIAA0447 gene product | 5.18274E-07 | 0.014513808 | 3.98659E-05 | 0.067547386 | 0.387763889 | 0.284673955 |
| rc_N22297_f_at | 721 | N22297 | hypothetical protein FLJ11085 | 0.054494667 | 0.052949003 | 0.08027668 | 0.000541487 | 0.869037035 | 0.000917296 |
| rc_N32521_at | 735 | N32521 | integrin, alpha 7 | 0.547891484 | 0.041933612 | 0.000238523 | 0.014113039 | 0.003549591 | 5.39907E-07 |
| rc_N34517_s_at | 738 | N34517 | | 0.005879801 | 0.196182153 | 0.004385481 | 0.00040993 | 0.928485921 | 0.000303466 |
| rc_N38882_at | 741 | N38882 | | 0.014629787 | 0.005666897 | 0.251351421 | 0.530957263 | 0.000663242 | 0.000303436 |
| rc_N51579_at | 748 | N51579 | transporter-like protein | 0.44766874 | 6.17952E-05 | 0.962144968 | 0.001295779 | 0.499475206 | 0.00139415 |
| rc_N54053_at | 752 | N54053 | secreted phosphoprotein 2, 24 kD | 0.116492665 | 0.015273471 | 0.039361645 | 0.00027615 | 0.641546757 | 5.23218E-05 |
| rc_N54845_at | 753 | N54845 | | 0.000443555 | 0.073889565 | 0.000793416 | 0.227981278 | 0.881125278 | 0.282635582 |
| rc_N55085_at | 754 | N55085 | | 0.220208071 | 0.876075911 | 0.000843717 | 0.384166413 | 1.49242E-05 | 0.003419797 |
| rc_N59862_at | 760 | N59862 | | 0.462122243 | 0.001300248 | 0.276791676 | 0.000214232 | 0.741521525 | 6.58223E-05 |
| rc_N66001_at | 765 | N66001 | mouse double minute 4,human homolog of; p53-binding protein | 0.269409972 | 0.001627722 | 0.449591713 | 7.93964E-05 | 0.741058833 | 0.000255792 |
| rc_N66053_f_at | 766 | N66053 | butyrophilin, subfamily 3, member A1 | 0.000767668 | 0.638609685 | 0.00012387 | 0.018876455 | 0.648066184 | 0.005990603 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_N67108_at | 769 | N67108 | | 2.22447E-05 | 0.94547199 | 0.335823565 | 0.000534028 | 0.00186846 | 0.462281008 |
| rc_N67324_at | 770 | N67324 | | 0.061297249 | 0.015332682 | 0.029486337 | 0.000101757 | 0.771895611 | 3.46367E-05 |
| rc_N67899_at | 774 | N67899 | | 8.19817E-05 | 0.845939057 | 0.027139019 | 0.000532728 | 0.100944503 | 0.04285656 |
| rc_N80693_at | 787 | N80693 | | 0.798568519 | 0.000819546 | 0.654401168 | 0.002677747 | 0.504907369 | 0.000334108 |
| rc_N89827_at | 788 | N89827 | RALBP1 associated Eps domain containing 2 | 0.129696038 | 0.000403735 | 8.58239E-05 | 0.032513633 | 0.022112053 | 0.895818166 |
| rc_N93495_at | 795 | N93495 | uncharacterized hematopoietic stem/progenitor cells protein MDS033 | 0.082365924 | 0.047090947 | 0.00063645 | 0.000799522 | 0.111310122 | 2.03892E-06 |
| rc_R00440_at | 802 | R00440 | ancient conserved domain protein 4 | 0.538637852 | 6.90248E-05 | 0.927092838 | 0.000926675 | 0.619532275 | 0.000178704 |
| rc_R17000_s_at | 812 | R17000 | NADH dehydrogenase (ubiquinone) Fe—S protein 8 (23 kD) (NADH-coenzyme Q reductase) | 0.000151792 | 0.075089669 | 0.000101925 | 0.149353698 | 0.926045731 | 0.12770179 |
| rc_R25116_at | 813 | R25116 | | 0.0420832 | 0.03125809 | 0.026701279 | 0.000169518 | 0.862052816 | 9.11635E-05 |
| rc_R40030_at | 827 | R40030 | hypothetical protein FLJ20047 | 0.567472456 | 0.000280009 | 0.804462147 | 0.002571098 | 0.436977215 | 0.000218515 |
| rc_R41798_s_at | 829 | R41798 | KIAA1374 protein | 0.000373432 | 0.706910506 | 0.012448736 | 0.000894251 | 0.315054178 | 0.014659398 |
| rc_R42336_s_at | 831 | R42336 | | 0.70873782 | 2.16988E-05 | 0.77916386 | 0.000163747 | 0.929588049 | 0.000119701 |
| rc_R42525_at | 833 | R42525 | | 0.050001405 | 0.071849508 | 0.013930003 | 0.000778775 | 0.63585747 | 0.000159677 |
| rc_R56216_at | 845 | R56216 | | 0.000821825 | 0.352494161 | 0.151440792 | 0.0002362 | 0.069860079 | 0.036903476 |
| rc_R66690_at | 851 | R66690 | | 0.548034357 | 0.001498849 | 0.392082801 | 0.000384981 | 0.808745096 | 0.000168251 |
| rc_R70212_s_at | 853 | R70212 | | 0.001627385 | 0.92358255 | 1.96242E-05 | 0.011419498 | 0.28878538 | 0.000540241 |
| rc_R82942_s_at | 856 | R82942 | | 4.27278E-06 | 0.038346252 | 9.40527E-05 | 0.06641734 | 0.511382181 | 0.207797821 |
| rc_R84968_at | 858 | R84968 | | 0.029165843 | 9.17654E-05 | 0.74623486 | 0.052010697 | 0.078018241 | 0.0004854 |
| rc_R89291_at | 861 | R89291 | | 0.000287625 | 0.129809655 | 0.120359785 | 7.72734E-06 | 0.049234398 | 0.005999323 |
| rc_R92737_at | 864 | R92737 | aquaporin 3 | 0.045317535 | 0.5460908 | 0.00076277 | 0.024731156 | 0.195577177 | 0.000722979 |
| rc_T15530_at | 879 | T15530 | | 0.039751248 | 0.19390811 | 0.000219396 | 0.003085344 | 0.11916961 | 1.53896E-05 |
| rc_T16556_at | 882 | T16556 | | 0.547027876 | 0.000733555 | 0.131501406 | 0.006096912 | 0.045271057 | 6.8433E-06 |
| rc_T49291_s_at | 895 | T49291 | lymphocyte-specific protein 1 | 0.023580272 | 0.159000442 | 0.000765019 | 0.00120856 | 0.296144015 | 3.27932E-05 |
| rc_T50387_at | 897 | T50387 | | 0.685476265 | 0.000770227 | 0.324729565 | 0.003799426 | 0.187347142 | 5.10594E-05 |
| rc_T53404_s_at | 898 | T53404 | hypothetical protein from clone 643 | 0.44780256 | 0.003673041 | 0.259379562 | 0.000720609 | 0.69168737 | 0.000191916 |
| rc_T54613_at | 900 | T54613 | | 5.52684E-05 | 0.022747185 | 0.000284729 | 0.000146584 | 0.701984774 | 0.40594297 |
| rc_T54617_at | 901 | T54617 | | 0.857947447 | 4.07249E-05 | 0.397904433 | 0.007483397 | 0.527265593 | 0.001199664 |
| rc_T65802_at | 908 | T65802 | | 0.012663512 | 0.532196596 | 0.000313482 | 0.000392669 | 0.291974796 | 0.000319721 |
| rc_T79868_f_at | 915 | T79868 | hypothetical protein 384D8_6 | 0.071499128 | 0.033264086 | 0.074047238 | 0.000824339 | 0.987909984 | 0.000412941 |
| rc_T82292_s_at | 916 | T82292 | protease, serine, 11 (IGF binding) | 0.000399556 | 0.678142361 | 0.051597503 | 0.029665506 | 0.130506724 | 0.043561586 |
| rc_T86121_at | 918 | T86121 | | 0.013631945 | 0.898945913 | 2.7658E-06 | 0.000751611 | 0.035142628 | 5.76483E-05 |
| rc_T87533_at | 920 | T87533 | | 0.989160192 | 0.000472522 | 0.644089183 | 0.10048575 | 0.64805004 | 0.002981136 |
| rc_T90038_f_at | 924 | T90038 | butyrophilin, Subfamily 3, member A2, butyrophilin, subfamily 3, member A3 | 4.93914E-06 | 0.243601757 | 8.38948E-05 | 0.007362582 | 0.547300658 | 0.031384668 |
| rc_T99373_at | 934 | T99373 | non-metastatic cells 5, protein expressed in (nucleoside-diphosphate kinase) | 0.026021837 | 3.07604E-06 | 0.711043501 | 0.008523742 | 0.078371167 | 2.98773E-05 |
| rc_W37384_i_at | 1001 | W37384 | | 0.000625839 | 0.217732697 | 0.000147234 | 0.096608548 | 0.7216482 | 0.048383963 |
| rc_W42483_at | 1003 | W42483 | hypothetical protein similar to mouse Dnaj1 | 2.97466E-05 | 0.676684762 | 0.03177051 | 0.000106724 | 0.05435082 | 0.028721568 |
| rc_W44558_s_at | 1005 | W44558 | adaptor-related protein Complex 1, sigma 1 subunit | 0.079864992 | 0.042988764 | 0.034848175 | 0.000669599 | 0.73367308 | 0.000215475 |
| rc_W60649_at | 1019 | W60649 | | 0.023339325 | 0.129224665 | 0.006757142 | 0.000824018 | 0.675851904 | 0.000206179 |
| rc_W80509_s_at | 1032 | W80509 | death associated transcription factor 1 | 0.000271744 | 0.148661601 | 0.000426903 | 0.10048575 | 0.910884693 | 0.122505852 |
| rc_W86660_at | 1034 | W86660 | | 0.150249394 | 6.18441E-06 | 0.557722374 | 0.001658036 | 0.418699422 | 0.000115844 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| rc_W93396_at | 1038 | W93396 | hypothetical protein FLJ10210 | 0.000180228 | 0.540603359 | 0.319667744 | 0.00021213 | 0.009081674 | 0.156804025 |
| rc_Z38551_s_at | 1107 | Z38551 | | 0.007617909 | 0.125060522 | 0.00394587 | 0.000220695 | 0.839190935 | 0.000107925 |
| rc_Z39874_at | 1110 | Z39874 | | 0.018342738 | 0.000251552 | 0.969844211 | 0.120049181 | 0.022998914 | 0.000387407 |
| rc_Z40012_f_at | 1113 | Z40012 | NCK-associated protein | 0.038639336 | 0.043854062 | 0.05138364 | 0.000255085 | 0.909554475 | 0.000374451 |
| rc_Z40332_at | 1115 | Z40332 | vesicle docking protein p115 | 0.028012659 | 0.10943539 | 0.012529791 | 0.000762549 | 0.7761268 | 0.000299824 |
| rc_Z41763_at | 1120 | Z41763 | | 6.03127E-05 | 0.827763366 | 0.002670862 | 0.00038983 | 0.338788944 | 0.006770727 |
| S75463_at | 871 | S75463 | Tu translation elongation factor, mitochondrial | 0.000271911 | 0.000533911 | 0.00172916 | 0.765671272 | 0.63019533 | 0.471338415 |
| S77154_s_at | 872 | S77154 | nuclear receptor subfamily 4, group A, member 2 | 0.720602576 | 0.932154297 | 5.84424E-05 | 0.829150677 | 0.000513773 | 0.001105408 |
| T40327_s_at | 891 | T40327 | electron-transferring-flavoprotein dehydrogenase | 7.27596E-06 | 0.215221988 | 0.819260055 | 0.011040692 | 7.74754E-06 | 0.167330005 |
| T89243_at | 922 | T89243 | KIAA1243 protein | 0.00081408 | 0.517949226 | 0.114764867 | 0.000657245 | 0.092965856 | 0.053186849 |
| U00672_at | 935 | U00672 | interleukin 10 receptor, alpha | 0.000287943 | 0.609290849 | 1.66617E-06 | 0.011540026 | 0.269359727 | 0.000474683 |
| U03272_at | 937 | U03272 | fibrillin 2 (congenital contractural arachnodactyly) | 0.000310928 | 0.332521737 | 0.209649826 | 8.44451E-05 | 0.025692948 | 0.04828388 |
| U04811_at | 939 | U04811 | trophinin | 1.5625E-05 | 0.755433375 | 0.054905474 | 0.000984445 | 0.022792101 | 0.194301082 |
| U04811_at | 939 | U04811 | trophinin | 2.20509E-05 | 0.327834193 | 0.000136465 | 0.002712738 | 0.383208442 | 0.025499623 |
| U09366_at | 943 | U09366 | zinc finger protein 133 (clone pHZ-13) | 0.000213171 | 0.5068558 | 0.61082811 | 0.000200267 | 0.00244941 | 0.288631384 |
| U11861_at | 945 | U11861 | maternal G10 transcript | 0.000482828 | 0.00167301 | 9.90184E-05 | 0.90794872 | 0.702310162 | 0.826191525 |
| U12775_at | 946 | U12775 | agouti (mouse)-signaling protein | 0.000271316 | 0.000844452 | 0.000473875 | 0.859392382 | 0.889729458 | 0.765131751 |
| U13220_at | 947 | U13220 | forkhead box F2 | 0.000592743 | 0.851887641 | 3.88357E-05 | 0.007392289 | 0.519237 | 0.001178975 |
| U13991_at | 948 | U13991 | TATA box binding protein (TBP)-associated factor, RNA polymerase II, H, 30 kD | 1.45014E-06 | 0.006140037 | 1.01255E-06 | 0.168790439 | 0.946149483 | 0.15190281 |
| U15932_at | 949 | U15932 | dual specificity phosphatase 5 | 0.877505283 | 0.806495835 | 1.85723E-05 | 0.914714787 | 2.57739E-05 | 0.000146058 |
| U23852_s_at | 954 | U23852 | lymphocyte-specific protein tyrosine kinase | 0.015926444 | 0.891018698 | 9.08522E-05 | 0.032567274 | 0.153847965 | 0.000703723 |
| U25265_at | 957 | U25265 | mitogen-activated protein kinase kinase 5 | 8.86395E-06 | 0.005417963 | 5.93432E-05 | 0.305372601 | 0.684875389 | 0.503461673 |
| U26174_at | 959 | U26174 | granzyme K (serine protease, granzyme 3, tryptase II) | 3.92686E-05 | 0.206902143 | 0.000598254 | 0.027205202 | 0.519267093 | 0.10031708 |
| U32674_s_at | 962 | U32674 | G protein-coupled receptor 9 | 0.003147245 | 0.1818672 | 0.076391484 | 0.000184255 | 7.37649E-06 | 0.847933992 |
| U40372_at | 963 | U40372 | phosphodiesterase 1C, calmodulin-dependent (70 kD) | 0.284766484 | 1.17113E-05 | 0.46702597 | 0.000897191 | 0.745348724 | 0.000311221 |
| U43527_at | 966 | U43527 | KiSS-1 metastasis-suppressor | 0.068750933 | 0.878566298 | 0.000141006 | 0.096679594 | 0.059509384 | 0.000920023 |
| U46006_s_at | 968 | U46006 | cysteine and glycine-rich protein 2 | 0.000581958 | 0.677096089 | 0.000421368 | 0.013813896 | 0.93464395 | 0.011277242 |
| U52112_ma1_at | 969 | U52112 | L1 cell adhesion molecule (hydrocephalus, stenosis of aqueduct of Sylvius 1, MASA (mental retardation, aphasia, Shuffling gait and adducted thumbs) syndrome, spastic paraplegia 1) | 0.012256648 | 0.603209864 | 0.000361314 | 0.009782964 | 0.313616052 | 0.000525936 |
| U55209_at | 973 | U55209 | myosin VIIA (Usher syndrome 1B (autosomal recessive, severe)) | 0.026307797 | 0.000534284 | 5.50778E-05 | 0.139252083 | 0.085728294 | 0.977237559 |
| U57623_s_at | 975 | U57623 | fatty acid binding protein 3, muscle and heart (mammary-derived growth inhibitor) | 0.000249597 | 0.006076702 | 2.31411E-07 | 0.680669423 | 0.152138423 | 0.095412354 |
| U58522_at | 976 | U58522 | huntingtin interacting protein 2 | 0.950874668 | 0.000404266 | 0.026015373 | 0.000816174 | 0.04004298 | 0.12201215 |
| U66075_at | 980 | U66075 | GATA-binding protein 6 | 0.000177786 | 0.094949773 | 5.41966E-05 | 0.129840147 | 0.784613111 | 0.079354568 |
| U66615_at | 981 | U66615 | SWI/SNF related, matrix associated, actin dependent regulator of chromatin, subfamily c, member 1 | 0.00427057 | 0.860602352 | 0.000125812 | 0.01088834 | 0.353965999 | 0.000781605 |
| U89922_s_at | 987 | U89922 | lymphotoxin beta (TNF superfamily, member 3) | 0.081431989 | 0.705262065 | 1.14225E-05 | 0.069803458 | 0.012069263 | 5.95219E-05 |
| W52493_at | 1013 | W52493 | | 4.17744E-05 | 0.407939223 | 0.47764998 | 2.61848E-05 | 0.001311163 | 0.165780725 |
| X06318_at | 1048 | X06318 | protein kinase C, beta 1 | 4.53981E-05 | 0.309598889 | 0.000193355 | 0.01564851 | 0.739435449 | 0.033361473 |
| X07315_at | 1053 | X07315 | nuclear transport factor 2 (placental protein 15) | 0.00096734 | 0.024484461 | 0.000091289 | 0.558914618 | 0.994799819 | 0.56276584 |

TABLE 6-continued

BPH vs. Normal and Cancer

| Affymetrix Fragment Name | SEQ ID NO: | GenBank ID | GenBank Name | P-Values | | | | | |
|---|---|---|---|---|---|---|---|---|---|
| | | | | Normal vs. BPHWS | Normal vs. BPHNoS | Normal vs. Cancer | BPHWS vs. BPHNoS | BPHWS vs. Cancer | BPHNoS vs. Cancer |
| X14008_ma1_f_at | 1056 | X14008 | lysozyme (renal amyloidosis) | 0.047298803 | 0.921767172 | 1.2563E-05 | 0.081015792 | 0.023720356 | 0.000192698 |
| X14046_at | 1057 | X14046 | CD37 antigen | 0.032116442 | 0.896768704 | 6.54708E-06 | 0.097237805 | 0.024859085 | 0.000287679 |
| X14830_at | 1058 | X14830 | cholinergic receptor, nicotinic, beta polypeptide 1 (muscle) | 0.936178672 | 0.000286907 | 0.137976127 | 0.000630986 | 0.183095639 | 0.024428637 |
| X16316_at | 1059 | X16316 | vav 1 oncogene | 0.005646314 | 0.4794965 | 0.000157845 | 0.002861938 | 0.337620027 | 0.00013174 |
| X54870_at | 1065 | X54870 | DNA segment on chromosome 12 (unique) 2489 ex-pressed sequence | 0.000450913 | 0.241248516 | 0.00029577 | 0.07293822 | 0.916408 | 0.059393045 |
| X58529_at | 1070 | X58529 | immunoglobulin heavy constant mu | 0.026942297 | 0.975028968 | 5.32141E-08 | 0.070184957 | 0.002196974 | 6.90925E-06 |
| X60673_s_at | 1072 | X60673 | adenylate kinase 3 | 0.014055428 | 1.64563E-05 | 0.000854329 | 0.036097108 | 0.40449053 | 0.17235001 |
| X63741_s_at | 1074 | X63741 | early growth response 3 | 0.050166995 | 0.302932401 | 1.63652E-08 | 0.522269647 | 0.000467351 | 0.000208487 |
| X66358_at | 1079 | X66358 | cyclin-dependent kinase-like 1 (CDC2-related kinase) | 3.6744E-05 | 0.079324094 | 3.35901E-05 | 0.080441339 | 0.984409054 | 0.077518373 |
| X66839_at | 1080 | X66839 | carbonic anhydrase IX | 3.93574E-06 | 0.662915937 | 0.008885816 | 0.000624117 | 0.057988735 | 0.078713562 |
| X68277_at | 1082 | X68277 | dual specificity phosphatase 1 | 0.003463894 | 0.023542489 | 5.00933E-13 | 0.79747022 | 4.48312E-05 | 0.000125081 |
| X72882_at | 1084 | X72882 | hypothetical protein FLJ10747,tumor necrosis factor receptor superfamily, member 4 | 0.000586574 | 1.73881E-05 | 0.061863645 | 0.20511364 | 0.136254698 | 0.01057929 |
| X75962_at | 1085 | X75962 | | 1.07753E-05 | 0.259082214 | 0.000322398 | 2.07333E-06 | 0.445393473 | 4.56511E-05 |
| X83705_s_at | 1089 | X83705 | platelet-derived growth factor beta polypeptide (simian sarcoma viral (v-sis) oncogene homolog) | 0.000211219 | 0.000641028 | 0.003169595 | 0.843987656 | 0.474177301 | 0.409652768 |
| X96584_at | 1096 | X96584 | nephroblastoma overexpressed gene | 0.000449835 | 0.36091834 | 0.013539811 | 0.00014621 | 0.323949108 | 0.003364493 |
| X99142_at | 1097 | X99142 | keratin, hair, basic, 6 (monilethrix) | 0.104620098 | 0.022019682 | 0.075077447 | 0.000384521 | 0.881497721 | 0.000232112 |
| Y07595_at | 1099 | Y07595 | general transcription factor IIH, polypeptide 4 (52 kD subunit) | 0.000268402 | 0.028695565 | 5.26844E-05 | 0.352269642 | 0.704788647 | 0.206775434 |
| Y09022_at | 1102 | Y09022 | Not56 (D. melanogaster)-like protein | 0.000142024 | 0.084289616 | 0.000108418 | 0.131801466 | 0.949831739 | 0.118236485 |
| Z35093_at | 1105 | Z35093 | surfeit 1 | 0.000740458 | 0.015177247 | 0.00173743 | 0.635076989 | 0.718277145 | 0.428942461 |

TABLE 7

|  | Prostatic tissues | Cell Line | | | |
| --- | --- | --- | --- | --- | --- |
|  |  | BRF-55T | PZ-HPV7 | BPH-1 | LNCaP |
| Up-regulated genes | 61 | 33 | 22 | 20 | 20 |
| Down-regulated genes | 43 | 31 | 28 | 30 | 33 |
| Total | 104 | 64 | 50 | 50 | 53 |

SEQUENCE LISTING (1124 sequences)

SEQ ID NO: 1 - DNA, 333 bp, Homo sapiens
  Genbank Accession No. AA004699
ttaataaagcagaaatgtatttattaggcacccttgttcctcacagaggagcaagatccaggcctgagcgcctgggaagtctcttgaggttgcaggaatctccagagaaacataggcgctgcccagccaccaccccgagaacactatttgggctggagtgtgaccgccgaggtgatcctggcaggaggctggggttggctcctcgactccacaaacactgaggagtgggtggggacaccattgacacccacccaaacactggcagagagggaaggcccttccagattctggggcacatgttgctgggcctgccagggggaaggaggagcctgg

SEQ ID NO: 2 - DNA, 426 bp, Homo sapiens
  Genbank Accession No. AA004901
  unsure (1)..(426): n = a or c or g or t
ataaagaaaaatgtttattttggctcatgcttctgcagggcgtacaggaggcatggcactggcatctgcttctggtaagggctcaggaagcttgcagtcatggcagaaggcaaaagggtaatcagcatatcacatggcgagagagaacaaagagctgccaggctttttaaagcaaccagatctcatgtgaacttagagagtgagaatgtaaggttagccgagagaaaggaccagagagagagagccccaagttcaggcaagcctttattaacctgtcggctgcccccttaacagtcaaggaaagcagccccaagcttacagaatagggggtttacattnggggcagggagtttgagggagtcctttggtatggctncatcccggggttgtctgctggttaatttctgccacatatcaccttgtgaa

SEQ ID NO: 3 - DNA, 433 bp, Homo sapiens
  Genbank Accession No. AA005382
cagagagtcttctaaattttatttagaataaaaccagcatggtagaaatacatcagtgatacaagtgaaaaagaacttgattccttaataaaatgacttacaagtgcaaaaatggaccccatatgtgctctgctttacttacacccaactctaacctgcgagcatattaggaaaaaagaagcaagtgcatccaataaaattatttgtaacttaatttgtatgaggcgggacaaggttgcttttgatccaagtctggtatttcttggttaacagggtgtagattccaggctttgtggcaacaccacattcatgacctccagagactatagcgtgggaagacacctttacagatcaaggggccccctggagtcacccttacaggaatccttctggcctttggaatcctcctggcacagaccatgtctttggtgat

SEQ ID NO: 4 - DNA, 287 bp, Homo sapiens
  Genbank Accession No. AA007158
tttcacaaatgtcaattttattgacactagtgcacaactaaatacaataattgcaaaggaagtggaacgtgtcaaacagaaatggtgacaatgagttagaactgcagttgtttcaaggtactacactattatttaaaaaaaaaactcacaaaaagaaaaatgttatcactacaagtaggaattagaagagagaaatcctggcagtctgtctagaggttaaaacatttcatgcatttgtgagttgctgttggagagtttgttttttatttgtccaccgtaatctggca

SEQ ID NO: 5 - DNA, 479 bp, Homo sapiens
  Genbank Accession No. AA009615
  unsure (1)..(479): n = a or c or g or t
ttttttattttttaaaataaattttattgtatatatttaaactatacaacataatgttatagggcacatagagataagatgcttactataatgtagcaaattattttaaaatttacactgggatatattgctttgataattataaagctatttttttcattttaaaagtagctaagttttcaacatttcaaaaactttttccagatcttctgtatacttttctgtaggcatcctagtgaaacatgtacaattcaaatgaccacatgctggagagccaggcgcgtccccatgcaggcgacgtgggcctcttagaagcagcctcctgagntgtgtagcctcctgcagccatacagtcccgtcctggtcgcccgtctcagcctcggtcctgagcagcctgtgggaatggtggcgacgggacagtccagaacactcctggacagcccctagccccagcccctgcccgcctctcgggagagcan

SEQ ID NO: 6 - DNA, 468 bp, Homo sapiens
  Genbank Accession No. AA009755
  unsure (1)..(468): n = a or c or g or t
aggtacttcaaaagccacatttaattcaaaataaaatgagcatttctgacagatgacaacagtatgaaactgatttttttctttcctagatacaaaaatgatatggggcatttcttaacagtttagtaatcgtctaagaataattgtagaaataaccccaattccaccatcccagccactggtataaaacaaataccttccatgaaactgtctttcacataactaaaatatcctcacttacttggaacaatttcatgcttacacatgatcacaaacatttgtttttagatgttgtggaattactggagctgagatttctgaaacaatatctgaatcttagcagagagataataatcctttcactatacattgcttgggcttccttaaccaaatctgagtaactactggtaataataatgctggtggtagtccatgatactctcaaatttttccctttaagaaatatan

SEQ ID NO: 7 - DNA, 229 bp, Homo sapiens
  Genbank Accession No. AA010358
ccattttgaacaacttttattatacgtttagtgttctctatacaaaagaaatcagtttttttacagtgattcaaaaaaaattcagaataatttggccttttcattgctcatgcagtcagtttataagtccatgtattagacggccctccatggcccagaagtcttccctgctgaaggtcgtgtgtgacaccctcagatacgcatctgtcactgacaaagttggttaatg

SEQ ID NO: 8 - DNA, 163 bp, Homo sapiens
  Genbank Accession No. AA017063
  unsure (1)..(163): n = a or c or g or t
cgcangatgancacttccgcgggggatgctcccggttgctctgcggagggcaggccgactcagggcggggtttggtcctgaaaaaatggggtggggcggttacctcttaccgcttgggaccttgggacctcttnttgaccccaggaagagattagaagccctt

SEQ ID NO: 9 - DNA, 127 bp, Homo sapiens
  Genbank Accession No. AA017547
cagatttaaaccgtctttatttctacagcaacatcttgaaaatagagagcagccgcctcacccgcaacagggggagcccctcctgccaccaggggaccgtcgccgcccctcgcgagaagctgcaggc

SEQ ID NO: 10 - DNA, 430 bp, Homo sapiens
  Genbank Accession No. AA018414
  unsure (1)..(430): n = a or c or g or t
aaacaagatagtttatttctcttcatgtaaaaatttgaatgacaatttagtgaaggtgacaagggcccacgcttctgctaaggtccaggcattcctagagtggtatatgatagatcatatggtataagatagatcnccttccatagccacagagtatccagttattaatacaaacaaatgagaagaggaaggggagagcaagtctttctttgtttttagagcacaatccagaagttgaattcctatcttagtcacattaaattggctagagtatcgttacgtagtcagacctagagttgcaaaggagactgaaaaaatgcagtttaatctgaacagccatgtgtccaggtaaaaattctgttattnagggaagaaagagagaatgaatattgggaaacactttcaagnctcccacaccaaagtactacct

SEQ ID NO: 11 - DNA, 196 bp, Homo sapiens
  Genbank Accession No. AA019034
tatctttacaaatgacagaatatttattaacaatacctttaaaaaagattacatatgctagatcactggtaaatatcatttacactggggttgggaactccctgggtgtcattttttttcgttcattttattattttgctgattttttttttgcatgtgattttaaattttatttcaacatagaagtaaccatatc

SEQ ID NO: 12 - DNA, 482 bp, Homo sapiens
  Genbank Accession No. AA019433
  unsure (1)..(482): n = a or c or g or t
tttttttttaagtaaaagaaaaagtgcggctgttaccaatctgaagtgggagcagccgcactttttttttttttttttaagtaaaagaaaatttattatgaaactaaaggaataaaagaatgaccactccataggcagagaaacgtcactttaaggttttgacatcaattgatttttgtccaaatcaataattactgcaatgattgaaaaatgattattactaagtttgttttcattgtctcaaggtctgctgaactctggatccaggctgtgtcaacagggtagtgtggtgcctcctgtacctgtcttggcctcctacagtcctttttacttattttgttttttagaattagagacagggtcttactatgttgctcagactgggnttcaaactcctaggctcaagcaatcttccagcctcagcctcctaaaagtgctggggattacaggcatgagccaccanacccgggccaagttctttt

SEQ ID NO: 13 - DNA, 373 bp, Homo sapiens
  Genbank Accession No. AA022615
ggtgtttctctcttttatttaaaaacagtgcttcattaccatgtgcaaaggctgaggcagtgctcctccttcgcttagagtttataaaagccagcaacatgatcaataatttatacacatggagagtaatacaaaaaaataaggaataaaagctaaagatctaactactccgaccttcacaattccagctacttgataataataggagtaacccaatgaatactgtatggtctgaaagctactatacaatatgattcttaacgagaagggaagggaattagagactgtcacaaagccctgggatgcttctctggagttagcagggaaacaggaccctgggcaagcagctcgggtgtcctaggaagtgattctg

SEQ ID NO: 14 - DNA, 245 bp, Homo sapiens
  Genbank Accession No. AA022886
  unsure (1)..(245): n = a or c or g or t
taaaaccccatgagatatttatataaagttactcagatttgggccgacatggcttatctgaagagtgcatgccgggtaaattcagggtggcttttttctcagggtctggaagtgtgagagtttctggggcagactttttccggggccgatctttgggaacggacagaaattcgggtgcgtctgtggagagaggggtggatggagcactagaaggcgcactgcggacngaaaaaaggccccccccg

SEQ ID NO: 15 - DNA, 337 bp, Homo sapiens
  Genbank Accession No. AA025370
ggatggaatacaatttccaatagtgtctaggccgacacccctccaccctcctttgcctgtcattcaagtcaataccctggagaaaagaggctgtgggggaggccatgttcgattaggaggtttaagagtccatcaaagtgtcatatgtgttaggtgtgaaatggcgacactgggaattactgttaataaggggtggctgcagcacggtgattgttatgagaacatccccaccgccccacttttgtttgaagactttcgtactgaactacatgttgtttactttcaacaacgtatacactacagttgacaaaagttaatctcggtgataagaatatgc

SEQ ID NO: 16 - DNA, 411 bp, Homo sapiens
  Genbank Accession No. AA026641
  unsure (1)..(411): n = a or c or g or t
tttntntgcaaagagaaataggctcgtttattnattcattgatcaactggcacttcttgaaancctgctgtgtgccaagcctttccccaaaggaggatatcagtgnnnnagnaagtctcagggtggaaaggacctggaccacacagagcaggactccagagcctcctccatatggcaggaatcaagctttcacaggggaaacgcaggatttcccacacatgcccatgcaacacttcaagtcacgcttgcactggccatccatctcacagaaattgggggggttnagcatcnaacattggccanaantcactnggnacttnccaagggttncnccttgttgggnttnggggggtnnacaggggncccggcanttnatgcnccaagtttcngggcaaanatttcttttttccc

SEQ ID NO: 17 - DNA, 471 bp, Homo sapiens
  Genbank Accession No. AA028092
tagcaatataaagaaagatttattttcaaaagtagcaaaacttgtttgaaaaaaatatatatctttaagtgaattactttataaatgtgactgtcaaagtcagctatcctatgatctacattttacaacatattgtacaaaagatacattgataggctcttatctatttatatatttataattacatattgcacttggaccagcaaggcttgcagagtcattcacggtagaagttaataaagttaaatagatgggaatctttgtaagtacaattgatctcctctggtttggaaacgaatctcctcgtcgttgtaaagtgttctcgcggggtgggacagagagaggagcattgcgagggggaagcagagacagagagcactgagggcaggggtcgccttcccggggcccgctccccccgggaggcggcctttcccagactcgcacctccaaggtcaggacgcggtggttcca

SEQ ID NO: 18 - DNA, 422 bp, Homo sapiens
  Genbank Accession No. AA029356
  unsure (1)..(422): n = a or c or g or t
gctctcagaggacaagaattatgttttattcatttgggagtacataggcggtatttaaacaatggtgctatcttaaacaccaaatatcaactgcagttcactttttccgtgtggggactaatatcaagatttcatatgaattatagtataatccagaagtatgaaaaaatacatcatatttaacttataaagcattcatctgcatgttataagatattacagtaaatacaattaggtacttaccattttatctttactttaaaaacaatgcctnttccaaaatataaaaaaaagacctatttttaaaganctatttaaagatngcttttgaaaacaacacttttatnttacnacaaatagatggtagtggcaacagcactcgtggatgtttacgngtaaataaaaatacctagtattccggg

SEQ ID NO: 19 - DNA, 253 bp, Homo sapiens
  Genbank Accession No. AA029597
gccagaaccaaacgtctccttttattgcaaggtcaaacccttttcattttgtctatttatacagaattttcactaaggactgctcgacgcaacagctgtgagtacattggtccaaccattaataaatagtcttaaataagaaaacaaacaggttgaaggaaagcaagctcatcgtcctgaacgagggattaaagggggggggtgttcaaaagagctttggatggaaataaataatctctttgctttgtaacac

SEQ ID NO: 20 - DNA, 186 bp, Homo sapiens
  Genbank Accession No. AA031360
  unsure (1)..(186): n = a or c or g or t
aaaatttaaaataaaattttattttatcttatactcaagttcagacaatagcatgtggtgtacattcaaaatttttgacaggtacagagcacattaaaaaatgaagacatgatcaaggagatgtaagagacaaatagacaacaacattctccctgaatctggaaaaaagcnagccnttagggtncc

SEQ ID NO: 21 - DNA, 206 bp, Homo sapiens
  Genbank Accession No. AA036900
  unsure (1)..(206): n = a or c or g or t
ctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccanaca

SEQ ID NO: 22 - DNA, 456 bp, Homo sapiens
  Genbank Accession No. AA037828
tttataattagaaacactttaattcctagccacttggcagcacttaaatatcagagccatccaagcatgccagcctttgaacttgctcagcaagagtagatgatcacacaactcttaaggtaaatcaaaattagatgaaggttatttattggtgtgacttttttcctttagtgagcttcctttacacagcatggtgtaaatagcatcagattgaatgaaaagtttgttaaatgcaaccataaataattataataaatatacatcaagtaactttacagcacacattttttagggccaaggtttggatctgtctggacctcaatgtgctctcggagaagcagccacgttagcagcagataccttacagcttgtcatctactcaagtgatggccaacagaagcttctgaactcctcccggggagggtagctgacaaggtccattcaaggggatgagga

SEQ ID NO: 23 - DNA, 494 bp, Homo sapiens
  Genbank Accession No. AA039935
  unsure (1)..(494): n = a or c or g or t
ttcagtttttggtcattttaattgtaaaaaccaagacatttatataaataagaccgctgtgtaaaatacgattcacccttctacgaaaacccttttcccacactcgaaangaanatagaaaacccagcagagagcagtacaantcagcatgcggtcccngatagctgaagtctcgggcnggccagtggttccctgcggaanagccttcgtnggtgganagnactcctggcccaggtggncccaccagannntcnntgaccntctcnangagacttgcnaggtangcagctcccnnacaccagccccttgngtctcaantntacgggtccaaggaggggacgggaaaggctgcttggtccccaccaaggcttggggggctgggggggcctgctggcccagtgaagatgcagtggtctgttcagcctggggtcaagttgggggaaagggtttctgaggggtcagcacctccccagaggacaaggagagaagctgcn

SEQ ID NO: 24 - DNA, 421 bp, Homo sapiens
  Genbank Accession No. AA040433
  unsure (1)..(421): n = a or c or g or t
ttttgagggtaatgcaacttcttatttattaatatataataacaacaattatacagctcatatctgcaactgttaggtctttgttatgtcttggtcactttgtctggactggccgtgaccttcagctccagggtctgggctaggaagacgttccagtgaccttcgtgggggccagcgagcagtcggaagtgctgtgcctctttctggaagtcttgcttcctgactttcttgatctgagtcaagtggaagattctggctgtgtggccttggcagggtacttcacctctctgagcctcagtttcctcatcttttaccagcttccagaggtagatctccaccaagtccgaggcctcngtgttcccaggggcaaagcgacgnaggttngtctngggctttgggggataccggatgttttggacga

SEQ ID NO: 25 - DNA, 486 bp, Homo sapiens
  Genbank Accession No. AA040731
  unsure (1)..(486): n = a or c or g or t
ttccaagaagaacatttttctgtttattcttagaatgtgaattttttttttcaactcagggccaagtacaaacttttgatttttgaaattttttcaactcagggccaagtacaatcttttgatttaaaaattttttttcatgaacaaaccatcagtagttattaaggagcccaagaaataggagatgtgaaagcaggatttctttgtgtttcctttgaatgttgttattttgagtattatcattatcaggtagaggaagaaaggtaggctgggaagtaggtccttatgatatcttgactatggatcccagatttacatttcacctngtcacagagcacacataatttaagataaacatgtcaagaatgacataaaccagaggtaaacaccaaggagctttacatttggaaccngaaaataaaaattagaaaaattattaccccatattaataaccaaaaaattacttaaactcctaggnccccngg

SEQ ID NO: 26 - DNA, 467 bp, Homo sapiens
  Genbank Accession No. AA043196
  unsure (1)..(467): n = a or c or g or t
cagagaaagaaaaattacctattacctattggcacatttctgttacgtcaagtctgggcttaagcctcgttggtcctgttaagctctttttgttctgtatcaagcaggagtgtcttgagttctttctaatccccatacatcatgtctttgaaatgacaaaagtcccatcctttgttgcccgtgcagtaatctgcttgtggaactctttaagaacatccagctggccaggcctgatgtggatgtatgaccggatcttggcgatggctcttacagcctcctctggactccatttgtgcacctgaatcaggtatgctgccaccatagtggactcctggagcgcccagccttacaatgcacgtaaacacactggcccagcgactggtacttgagagcaaattggactccctttctggaggttgtccaagggtgggggaatcccagtcatggtctacngtgccctcggtgcc

SEQ ID NO: 27 - DNA, 546 bp, Homo sapiens
  Genbank Accession No. AA043349
cttttatgcagagtttgattatgctttatttttaaaaatcacattcttccccattcccagccaacgaacaacactattcattctgaaataagaaaatgaaagaattttgagaagtcacacaacattgctgtaaatttcattttttttttttttactaataaaacagatgcttctttctcagagatgggttttcactttcaacatgcgtcatagcatctgattttctgagccatcttgggaaatggagtctttcctaatgtcattgaatgtggtcaaagctatctacaaagcagagacagtaggctcttggtgaatcagtttgggaaattcacaattaagcagtctcagggagtgaaattccggggtctgatgagactgtggaaaccatgtggtactgtagggagagcacaggtttggatgccagacaaatatctaaatctaaccctaatccactgcttataagcttagtgattgttgcacaagttgtttagcttctctgagcttagatacctcactgtaaaatgggaataatacctctttttagtg

SEQ ID NO: 28 - DNA, 353 bp, Homo sapiens
  Genbank Accession No. AA043777
  unsure (1)..(353): n = a or c or g or t
gaagttataaaagcttgtttttctttattagaatacttttttcaattctgatttgtcacaatttagattctttttctaagaataagcagaaatttacaaaatttaatttttatttatacattcatccgttcaatacacatttcaagaaagctgtattgnaccccttnnagtnggtaagttccagggccaaagaaccaaaataaatccaaggagagagaccaacaaatgtatatttataacacagagtaataaaacacaaataaatgtggagttatttaagcatgtaagatggtacatgctctaccaaggtatgggggcttctctaagacacaagatcagattaaagtcttgaa

SEQ ID NO: 29 - DNA, 382 bp, Homo sapiens
  Genbank Accession No. AA044219
  unsure (1)..(382): n = a or c or g or t
ttgcggggaatcaggtaggggcctttattggccagcacacatctacctcctggcatctgtcacaagcatttgcaggagtaggcggccccttcctctccatgtccccatccccaacctgagatgcgggagggcctgggggctcagagggaagaactgaggcaagaagccccggtgatccagtcagaggattgggcagcctgacctcggggtggggagccagcactngacaacaaggagggaggggcacaggagggctccccgaggtttggtccgggagggggaggaaaactgccccctgcnctgtcaatctctgcaatgtgccgagccccagctccttgantccctcagtgcctttgggcctggatgctcaganagcagttga

SEQ ID NO: 30 - DNA, 428 bp, Homo sapiens
  Genbank Accession No. AA045481
  unsure (1)..(428): n = a or c or g or t
tttttttcagtaatacagatgtctattttattaaaaaagttacaaacaggtggactgcagggtcgtcttacaaaatgacaagaatgaaatctattggaaaaattttacttttacaaatctttataggtaattgttcaatgtttgtacttgttatttgagattttacctttcactgataaagttacagtacattagatccatgataataggttacattattttatttgcagagccctactgcagtgatttgaacaactcctaaatagatgccataataaagacaagacatatattgcatttaatattaatttattatcctaataagcaacatgcaatctattgaggaagctaaaataacttttggtcccctttcttaaaatgtgctggagaaaccacccttaaaatcactttcccccggattccngcga

SEQ ID NO: 31 - DNA, 328 bp, Homo sapiens
  Genbank Accession No. AA045487
ggaaagcattttcaaactttatttacaactgtcacagtgacaaaaagtagtttggaaaaaaaaaaatgctagtttctccctgagcctcaaaaaagaacagatagaagttacaggaggttcatctcacaacaggcatttttactgaaatactaggaattttttcaatacaatcagttagaaatacacacaaattacttgaaaaaaaaaaaaagaggaggccagataggagctcagccacttgtccaagagcagctgggtccccccagcaggctccaccgctgagggtcctgacattagctgtcagcccctggcctgctcagactggcaa

SEQ ID NO: 32 - DNA, 402 bp, Homo sapiens
  Genbank Accession No. AA045503
ctgtgagactgtcctttattgtgtatacaggttccagcgtcagggctctcccacggccccctccccagtcctcccccaagggcccagagtggtgggagtgagaggccaccctaaggcacactgaccagagaggcatggagggaggaggctgacttgccctggggacccctgctaactgagacccacccttcccctccaccctgcttctgtatgtgggagacgaaaccaagagtcactgggggcagcaggcatttcccagggttaaggctgatggaaggtccctatcccagatgggagatgggggcttttcctatgactccccccatcccccagctggaagacgtggggaggggtgcatagccttagagaggtagaatgaggggaaatactcctcagtgccca

SEQ ID NO: 33 - DNA, 437 bp, Homo sapiens
  Genbank Accession No. AA045825
  unsure (1)..(437): n = a or c or g or t
cagtgtagaccgtctttattggcaggtgttaagagtgcaaaatatcaacaaacccaggggaatacgcaagggggtgggagtatggctcccctaccccatgtgagagccctgtaaccaagccagtggggtgggaacgttgacttgactgtngcaaattcaggctcagcaccttccaaagaacaagctcccaggcaggagggctccttgcaacacaagggggaaaggagtggcaccctggaagggcctgggctgcgacccaccctgggctgcttggctcctgtatactgcccacctcaacccctcaagaggaaggcttcacagctgggggtatgtagttcagagaacccgggctaaacccagccctccccaaacccaggttatctgcctcgggcctcagtttccctcctcccagtgattacccaagttgggcccatcag

SEQ ID NO: 34 - DNA, 397 bp, Homo sapiens
  Genbank Accession No. AA045870
  unsure (1)..(397): n = a or c or g or t
gtttagagtctaaaactaaaacctaatcatttngtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgnccccctcatttcccaaatgtttaaantgtattnggatttgggattctcaaatggtataagttggcct

SEQ ID NO: 35 - DNA, 564 bp, Homo sapiens
  Genbank Accession No. AA046426
  unsure (1)..(564): n = a or c or g or t
ttttttnttttttcactttatcatttactttttattgtgttgcttgaagtacctatgtaatgcaagtatgtactgtactaaaatacctatatttccaaataacatatgtggtgtagcccacagtctctgcagaagcatcatgagtaacctgtgcctttacactttacaatccgttattggttgctgttaaaagtatgataacagatgaagaaaaaaaaactaagtatgaatacacttttccaaacacgcacatacacagcttacaatggaatcccaatggaaataagtgacaacatctgatgtagaatctataaaatgtagactctgcaataaaaagccaaaggacgtaaaaatatattttaactttaaaaataacttagttacagtaatactttgcctgtgtcttaccaacatgtagctgacagtcaaaattttgcaatatagatataatatatagggatatataagaactacaagaaaatccccaaaacccataaagttcaaatgtgaaacagaaaagtttaacctggagattcgctatggtganctagccatatttggaag

SEQ ID NO: 36 - DNA, 560 bp, Homo sapiens
  Genbank Accession No. AA046840
  unsure (1)..(560): n = a or c or g or t
tacaaatactgtaaaaattaatataaaaaagtgagcatgctcagtcttttcctcttatctacaatacaaagggtttgtctgaaaagtctggttttttttctttttacaaatgtaccttagctgcatcaacaggagtaagatgtagaaaaagctaccattacaaaaataatttaagggaaaataaacacgtttagcttctctcgcagtttagtggtggtaagtccaggctgtagcttctttgcgctcctatgtcccaagaaactgcagcgggcacccggcggctctggctgcgcagggcagggcgcgctccgctccgggccgtcgggtctgaggtatgggtcgttgctgagtctctcccgccccggccgcgcgttaccggcagtctgctgtcccggcggccggcagaagggcgggctgggcagctgcttgaagaactgccggagggccaggtcccgcgtgantgctccacgcgctggtgcagttctcgtttcagcgacagctcacaactttgtgcantcctggttgcgccgcttggcttgtggggtttgcnacgggatgtt

SEQ ID NO: 37 - DNA, 464 bp, Homo sapiens
  Genbank Accession No. AA047151
  unsure (1)..(464): n = a or c or g or t
agaaaaaccaccatcgtgtcacgtcgacgatgccaaattatgttagcgtgacaganaacaccgtgggggaggaaggcagcagctgaagaaaaaagctcaaatgatctagtcactttcgatactgtacttcagatgcgaaatggatattcngagtggaaacctgacaaagtgcgcctgctttgatgtgaactggtatagacaatgaccagtggctgggtcagtgggatgtctctctgtgagcacaaaggcttatcaaatgacactaaagataagttcaacaaccatcacattggaagggagaaaggccgaacatttcatgtttggccgggcatgtgagtgcacaagatggaaagagcgattggagcatcctggtataattacccccattgtgctcttaatggaaatttcaaaggacgggagtattctgttggttggtgtccaggtttgtggcactgttccaagag

SEQ ID NO: 38 - DNA, 413 bp, Homo sapiens
  Genbank Accession No. AA047880
tacagagaatataaaaatacattcactttattttagaaaaatgaagactcatagagtaagcttatcacaaactggcctattaggagtcacagaattcacaggaaacaatttctgaagaccaggtgcctgctgccacctctccaagcaggccagagtccagtagagaatgcgattcaggaagatggctcctcagagggcagggaggttagctacggaggccgctcacgtggaaatgtccagtgaaccaatgccaaggaagaagataaaattctctggggctgaccacaacagtgggggtggataaagacaaaccacttgcctgtacttctcatcttctatttgttcatttcactgctggaaggtgacctcttttcccctaatcttctttcaacccagagagtttaagtcttctc

SEQ ID NO: 39 - DNA, 316 bp, Homo sapiens
  Genbank Accession No. AA053267
ttttttttctcactgcaaaacaactttttatttaaaaggccaataatgagaataatgagttgcacaagaatgaaaaccttatcccttccaaaagatcggcctatacattatgtataaagttagaataattctaaatacaaaatgccaaagaccagcgggtccactccttcctctcctaagccatcttgacagtttcacatttcagcttccagacgtcatttctgttgcttttaagggtgcttacccagccgtggtctgtaccagacagggtagttggcacagcgtaggcactgccagcaggcccttgggagcttgg

SEQ ID NO: 40 - DNA, 431 bp, Homo sapiens
  Genbank Accession No. AA053424
  unsure (1)..(431): n = a or c or g or t
tttgagctttcagatttgcttttattggtagggaaattccagagtggggagccacccaggaggagacaggggtgccgaggcttctgggagtctggaagctcccggatggagaggcttacagccccagccttccccagcaggagcacaggcaggggactggccaagtctgtcagctcagagcaggaccggcttcagggcctgacttcggtctcctcttgacccgccccggaggcttgtggtgggctctgtgtttgcagctctcctgaacagagctagatgagggtgggaggcccccgttggctcacacagtggatgctaccatctccggcctcttggatgtggagctctgtgccagagtcaacagtctccagggtgggccggaagttgttgtaggcgntctcaaggccgaaatctgctcttcctcagattct

SEQ ID NO: 41 - DNA, 294 bp, Homo sapiens
  Genbank Accession No. AA053883
ttttttcagagattatgaaaattttattaataaagaaaatctgcattacacatatcccctttaaaaacaaccacctcaaacatgtagaaatgctttattttgtatttgctatttgatcaatgccagaaaaatgaaaccacaacaccaaagtacagaccagtatttttgaaggggataataatcatttgagataataaactactagaaaatcagaagaaatgattcaaggtattcatttcaaaggctaaaccactaattcttcatccaaacgaatgtttccactgtgagtcaata

SEQ ID NO: 42 - DNA, 426 bp, Homo sapiens
  Genbank Accession No. AA054222
  unsure (1)..(426): n = a or c or g or t
aaacattggttactttatatatgactttcttctggtagtggcaaactaaactttttaggttaatctcctgctaagaaacataaaaactcaacatatgctagaaggcactgaagagctaacaagatagattaaggagacactagtccagcatttagtgctgatctaaatgtcagaagtggctgtgactctaaacagagcttttgacatgctacagcagaggacggcaaactatagcccgtgtggcaaatctagccttgcacatattttgtaaatacaggttcactggaatacatttatctcattaatttattgtttattgctgcttttgcagaacaatnggcagagttgattgttgagacagagattgggcctacaaagactaaaatatttattctctagtcctttacagaaaaagtctgccatcac

SEQ ID NO: 43 - DNA, 251 bp, Homo sapiens
  Genbank Accession No. AA055081
ctattatgatatgtttatttaaagttcaaaaactggccgaactaaaatctacttgtattggaacacacctgaatgtgatgaaagtatacagaaaagcaagaaagttatttaaataaaagtcaagatggtggttacctcttaggtgggggctataatgagaaaggaaggacaagatagagaaggttcttactgtcagtgttccatttcttgatttggtggatacaagtgtgtttataattattctttaaacc

SEQ ID NO: 44 - DNA, 451 bp, Homo sapiens
  Genbank Accession No. AA055163
tttttcaaaatatgagtttaatgacagaattagttagctagtattccacaaaaagtattgctctattttcaaaaaatttgcacagtgtcttacacatgtgctaaaagattgagaaaataaattagaaaattatactgcacacttaacactaaatctaccaagcacaatgtaacttttagacagctcagaaggcactttgggatttttttttttttcagtgcctcagggatcagtatgaactccaattattgttgccctggccaattgtgggagtactgataactggagagttaattgactgctggataaagcaatctttaatctaaatggggaaggctcactagcagctacagaggaagggggtattcagatcccagcttaaggctaggaagccagctgacccaatcagagacatgaacccatcagaaaaatgtaaaagttttcatctttc

SEQ ID NO: 45 - DNA, 354 bp, Homo sapiens
  Genbank Accession No. AA055768
tttttttttttctgttcaaaaaaggttttatccaaaaaagttaatcaagacaagcaacagatactgcaaagcattatatacagcaccatagtccaggggccaaagaaatcaggaggggctgggcagtagaggaattccatatattaatgaatgtgagattaagtatagagtgaagacattaacacacaatttctaatttctgttaggcagaatgctcccctaccctgatgccacagcctttcacgtttcctaaaccctagtaacctctgatctccatctgcctcatcaacacgtcaccaccctttgctcttcttccaatttagtcacatgttgggctgaatttatttccactcc

SEQ ID NO: 46 - DNA, 610 bp, Homo sapiens
  Genbank Accession No. AA056121
  unsure (1)..(610): n = a or c or g or t
ctccccctccctgctccaagccggagggttcctgaggtgacagcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatnccagagttatattgacgaatgtctgggaacgggttaggaagaaatcctaaggncccacctgtactgagggaattggtgttcagcaantgcatcaggga

SEQ ID NO: 47 - DNA, 404 bp, Homo sapiens
  Genbank Accession No. AA057195
  unsure (1)..(404): n = a or c or g or t
agaaaaaccaagtgtctttattcctcgatcgtttagtatggcggtgggcggcgcgcgcgggggagcctggagcccagggaatcgacctggagggccagtngngggancggagggtgcgaggntcggctcctccgcagccggccctggaggggttcttgggggatcgcgccaggccaaaagtctgcatgggcggccccgagcctccctgagccggcgcgccccgggnttngggagaggccnctctgnncgcggtgccgntgcgggcccgggtgcggcgctcgcccaagggctaaggtgccccgtctcaggcgagaccccaggagcccgccgcccccgctgtctcttcagccgacgtagacacgtngggccgggaaccccagtcttaacgcgtgttcaagctctgg

SEQ ID NO: 48 - DNA, 491 bp, Homo sapiens
  Genbank Accession No. AA057829
  unsure (1)..(491): n = a or c or g or t
cacggccagcctctcctgcagctgcgcgtngctcacctcgctctggcccctggtgccgtccacctccagggtggcctcaccgtccctcagcgagacggtgaccacgtgctcttggccgtcgcagacttgatctccattagggccaaggcgtatgctccacggccaggaccaccagctgcttcttgagtttcttcgtggagtgatagtctaccagtgccacagagagaggcacggcacggaggtcgggggcccagangcgcaaacaagcacgcctgtgtctgcggctgggcggattgtgaagccacgacttctacttcccaggttgattcagtcccgacgtccagaaggggtccgcatgtagtccaggctgtagaaggcgaagcttnccccggggttagaaagaagcctctctccgtcaccgagaagcactgcatcctcgtgttnatttcaccgttttcctggatggtggtgtcttctccgttcagccagtt

SEQ ID NO: 49 - DNA, 333 bp, Homo sapiens
  Genbank Accession No. AA065173
  unsure (1)..(333): n = a or c or g or t
ntttttcatgaagaccagtttattttacatgcttgctttcacattctttactgggaatttaaggccttttttcagccttaacttgtataccaacctcaaggattttgtttgatacagaaaaggatagggctgggccttctgccaaggactgataacctgcctgccaaaaggaagagggaatgaaagccttttgtccttctaggccccttacagtacctcaaaatctaaaggccttaaaggggaaaaaaaccgtatctgttctttctccttatctcctacccttctctttaagcatattgaagatggacttttttccaaatgtttatttgtagg

SEQ ID NO: 50 - DNA, 471 bp, Homo sapiens
  Genbank Accession No. AA069913
ttttcatgtcagttattattactttattacattttgggtctcttactactttcaatacagtacattgtcttttgaatgttacataatacaaaaggtattggacggttttaaaaataaactttaactacccattgatacatacttgatgacacaagttcttccatatacaatgcaaagcatacaaaaaatacattaggaattctactttgtacagtcgttcattaaatagtatttacacatacattttcaggttcctctgagtatcttgataaccccttgggaagatggtggttaagttcgtccttacaaacttaaatttgtaagtcttacatctgaaataaaagagctcaggtaaacttagaactgaccgagcctgagctagggaggacaaggagggtgtgggggaagcagcctggggcatggcacatgggtgaaggggcgtcgcacctccacataggcctacagtaccgg

SEQ ID NO: 51 - DNA, 436 bp, Homo sapiens
  Genbank Accession No. AA070752
  unsure (1)..(436): n = a or c or g or t
acgtgcagttcagtcaatgaaatcctgaggattggataaagtaaacaaactgaaatggatgcatcgtaccatctactgatgaggaagatatgaggtcctagttgtgaatcatgaaatatttagagtctgggtacccatgagttagaagaggatttgctgaggtcatttaggtcttcattctgctgtgatgtccagttgagctactgacggtcctctggctgcttctggaaactgatgctggcataggcgcttaaatcctcacttgagcggcgggtggagctgctctcaccgctgcccaggggttgatganngggtgggggtgggggaaggctgcggttcaggggtgcactcctgagggcactgtttgaagtccttgaccaaatccaggtctatgtagttaagaccattctccaaacccccagcagccccacacagt

SEQ ID NO: 52 - DNA, 458 bp, Homo sapiens
  Genbank Accession No. AA071558
taagagaggaggatctcactctgtcacctaggctaaagtgcagtggtgtgatcataactcactgcggcctccaactcctgggctccagcgatcctcttgcctcagcctcccgagtagctgggactacagatgcatgtaccacccacagctaatttatttttatttctgtatagatggggtctcgctatgttgcccaagctggtctcaaacttttggcctcaagcagtcctcctgcctcggcctcccaaagtgctgggattacaggtgtgagacacggcacaggaatcatttatttttagcccccagttctgcaaatttggcttctggggtcacccccaatttacagacagggaaacagattcttaggcaacatgtaactcacctacgcatcctgaagtgtctaagtggcagagtgctggggcaaaaggtgccactcgataaacatgttttaggtgaat

SEQ ID NO: 53 - DNA, 242 bp, Homo sapiens
  Genbank Accession No. AA082041
cagaatagcatgcaattttttattgttttctaaatctatttgtacacttaatatgctagtattaatttcacaaacagtataaagaatgtactccaatgatattacgcggcaactactcacctgaaaaagaaaacattgtctctgaaataattcctaattatacaattttgcaaataagcactataaatgttaaaatgttaagacttcagtgtaataatgtcaataacatcctgcctttttaa

SEQ ID NO: 54 - DNA, 567 bp, Homo sapiens
  Genbank Accession No. AA082546
  unsure (1)..(558): n = a or c or g or t
agagaagaccgtggatcacctggggacagaggtgaaaggcctgctgggctgctggaggagctggcctggaacctgcccccgggacccttcagccccgctcccgaccttctcggagatggcttctgagccctggagctggagcccagcagttggaggtggtgcacctgccaggcagcgccacagaaccagccctgtcctctcgacttccttccttagcttcatgtgaaataaaagctattctggtctcctctgtgtctgctgacagagtaacccgtttaactacagcctcctctcactccacttccatgcctggaggaagcctgcaaccccctccaggctcagacctggggacacccccantcctgtcatttataggggaagatggagcaggggttgattcacacagatggggggccctctgaattggcctgcttctcagaatgttggccataggtnaaaagcaaggggatcggggttcaggaccancagaatgtttagtgaatctgnatgaatgagaccccaggatttatgtgtccattaagtggttgttgtgntttaaaaaaaaaa

SEQ ID NO: 55 - DNA, 328 bp, Homo sapiens
  Genbank Accession No. AA084138
ggttacaagattctttattttgtaaactatacataaacagtaaaaaagaaaatgcattatactttattacgtaaagtcaacattaaattttgtattgagtgtgtataaattaaatggaaataattaatcaattttgctttcaatgaattgtatactgggaaaccagtttacccactgttgaaattaaagataccaatacgtaacattcaacaggtttttccatttttattatgggcacaaaaccattggtatgatatagttaaaagtgatggtgtgccaaaatgtctacacaattaattaacatgctaacttaaatacagcggttaaa

SEQ ID NO: 56 - DNA, 412 bp, Homo sapiens
  Genbank Accession No. AA084324
tttaggaaccaaattcatcatcattatcacacaaaggcatttggaaatgtcaccttacacatggtgagcacatatgggtgccagcccgagacagcaggataagtttcacaaaacttgaccaggcaggttagaagcaaggcatggttcaggatggcagagggcagggagacagaagggagtaggatgggagagaagagccagctggaagatgagtcagggggtgcaactggggagagcagctctgaatcctgcttctcagtgagaaagttgctaagatggctttgcagggagctgtcctatcgctgctcgagatcagcctgctgggcctattgatgataagcagggctgaccctcttgggctctgtagctaagcccaaaccctgctgaaaatggggcggggaggttgaggcag

SEQ ID NO: 57 - DNA, 412 bp, Homo sapiens
  Genbank Accession No. AA085608
ttagagttaacataatatatttattttaagtgccattcatgcatatcagttctggcagcaacaatcctaatgacacttggaatatttctttacagcactaaacagttacaaataatggttgccgttcatcatagaggcaaaatatgaaatcgtgcaatagcaaaactgtagaaacattaaaacactgactgtccaacagcagtacagagagcaggttgtatctgcacaaaaagccaatgcattttcatcacatatatacaatatagatatgtacacatcaccctctgaatgaacaatatcaaaatactctattccatttgaaattatccccggattgattccctcccacttcaaaggacatctgagcgacacgtatttacaagaacacacatgaatacatttacatttcaaa

SEQ ID NO: 58 - DNA, 370 bp, Homo sapiens
  Genbank Accession No. AA085943
  unsure (1)..(370): n = a or c or g or t
agaacccagcggtgttctgaggggagcgtttatttcaagcnaccgatgggacaaacantcccaggcttcccaggtgncantgnccggggcggcatcctcacttccagcggcctccaacgcggcccttccctgcccccttccggaacttctgggcgtggctgatgcggttgtacagcacgttgatctcatatttctgctgtttcagcttcgccatcaggtcgaacttctcagactccagctggtggatccagtccgacagctcctgggctttctcccggagctgttcctcccccatgtaagtcaatgttcaagagggcttcttaacgctcggaaaaggaatgcgcaccttcatctcccggcccccgtctgg

SEQ ID NO: 59 - DNA, 406 bp, Homo sapiens
  Genbank Accession No. AA086264
  unsure (1)..(406): n = a or c or g or t
tttttttttttttttttttttttttttttttttttttttttttttcccanggaaacacttttatttcnggaagtcagaagaaaaacaangngcacaacctgaatgacacagagcggcagntggaaaccacaggggctgccganagctggcctttcacagcagaccactgttttccagtgagaatggtgggccattccaaaacaaagctaaagggttccaaacatccagaatggaagctgcttcccccaactccattacctatactacaggatggattgctttttgtgagaccccttcttccactgggcaattttnggcattatttaccctccccccgatttttaaaagctaaaatggcgtcccagggaagaagtgccggcttggatgcangcttgggccantcact

SEQ ID NO: 60 - DNA, 250 bp, Homo sapiens
  Genbank Accession No. AA091278
gtttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggagggcggagggggtggcagtacta

SEQ ID NO: 61 - DNA, 299 bp, Homo sapiens
  Genbank Accession No. AA092215
ccgacatgaaggtgtcagctgtgatgcatgtttaaaaggaaattttcgaggtcgcagatataagtgtttaatttgctacgattacgatctttgtgcatcttgttatgaaagtggtgcacaacaacaaggcatacaactgaccacccaatgcagtgcatattaacaagggtagattttgatttatactatggtggggaagctttctctgtagagcagccacagtcttttacttgtccctattgtggaaaatgggctatcgagacatctctcagacctgttacttctaaacatgcagaaca

SEQ ID NO: 62 - DNA, 307 bp, Homo sapiens
  Genbank Accession No. AA092716
gcgagtctggaactctttcttcggggccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattcccccagctcctggagagatgtctaatatctcttagggaccagaccctaaattctctctccccatttgatgttagtgg

SEQ ID NO: 63 - DNA, 309 bp, Homo sapiens
  Genbank Accession No. AA093923
gtcataatggaccagtcatgtgatttcagtatatacaactccaccagacccctccaacccatataacaccccacccctgttcgcttcctgtatggtgatatcatatgtaacatttactcctgtttctgctgattgtttttttaatgtttgggtttgtttttgacatcagctgtaatcattcctgtgctgtgtttttgattaccctggtaggtattagactgcactttttaaaaaaggttctgcatcgtggagcatttgaccacagtggacgcgtggctatgcaggtgattcctcagtcttccttggtct

SEQ ID NO: 64 - DNA, 271 bp, Homo sapiens
  Genbank Accession No. AA094800
gcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgttgggccctagaatactacgacaaagcctttgaccgcatcaccacgaggagtagaggccactgcggcatcaagcgcatcttcaca

SEQ ID NO: 65 - DNA, 323 bp, Homo sapiens
  Genbank Accession No. AA099820
  unsure (1)..(323): n = a or c or g or t
gtgacatgttttttgctttattgaaattctctcttacaaaaggtctgangtattttaggccaggcctaatttgctttggtccctgaaatgcaggcccatggtcatttccatgtcctctgaagtaggtatgtaaactagtagacttccatttttaaggttcacacactttttaacattgtttttatttgatgtaaaacaagacttatgttgtccctaatggaaagaccaagtaagagagttatgtgcgtcttcatggaagggataactggattctttgccagaaccgggttgggaatttagtttgttcaatgtggcatctttca

SEQ ID NO: 66 - DNA, 431 bp, Homo sapiens
  Genbank Accession No. AA101767
catttcataaataatgtactttattttattgcatatggctattaaggagggcatccatgatcaatacagactaaatacaatgcactattctagtccagtttattctcgtctccagcagcatcacattgacccctatatacagcgtgtacagtggaagacagagcaagataagttaagtctcttgtcatatcacaatagcaagaaatatatttaacatcttgatatccagaaacaatacgtacccaaaaagaaaacactgtttaataactgttaaagtttatatagcaaaaaatattttaaatttaaggtaagtcaggcaaaatgtacaaagacccaatatacattgtgaagttttagcaaacataacatttatacattttggttccattctgtaaactaaattaaaaatggtaaatattgcatatgccttt

SEQ ID NO: 67 - DNA, 260 bp, Homo sapiens
  Genbank Accession No. AA102489
agtctacaagttcagacccacatgtaacggatttttgcttcatggttgtcagaggctagtgtgcattatttctgaggattatatccaatgacacgacgcagaaaacacaaatggacggacagacggatggacataatcattaagacaagagactctaaaacgtgccttagtgtccacgtgattgatctaaggcggggacccttctaaggtggggacccgagtgatctaaagcagggtggcttccagcacaagggtgccga

SEQ ID NO: 68 - DNA, 446 bp, Homo sapiens
  Genbank Accession No. AA114858
tttttacacaaagaaaaagattttattgtcttcttagtcaatatccctggtgaaattagaggcatagcttgagactggtgacagtgcaacacagaccttcaggagctgctttgaggactggcctgcccagatgcctgctgttaagccagcagccccctcactccggcccctgccatcttgacagatggagctgccatggtttcagggacactcagcagggcatctgggttggtccctcccacatggaccttgtaaagttgctattcaggggaacctggtatcgtttcaggcaaaacacagaaccatattagcacttctaagccccctgccccggccgcctccccggaacatttgggcttgtcgcacattccaggagggagcaggagcacagctgcagccacagctgccaggaacaggcctgggctcccgcctgtgtggggggaagg

SEQ ID NO: 69 - DNA, 365 bp, Homo sapiens
  Genbank Accession No. AA121142
  unsure (1)..(365): n = a or c or g or t
ttttttttttttttcaacaaactcagcttgactttattacatggaagcttgcagggagccagcggggaaggcctgtctgggcaggaactccatggctgggctggactggactgagcagttggtgttccagatctgccggggagaccagatcaacagcctgcctcttcagtttatatccggaagactcgcccaggtcctggctacttggggccaaggtaggaaacagcctttcctgttttgttgagggttgccancagggtgtctgagctgtgcccaaagtcgatgcagaccttctttttgggcaaggtcaatgttgaactccantcctcccaagcttgtttgaaggactctggaaaacgggtttt

SEQ ID NO: 70 - DNA, 564 bp, Homo sapiens
  Genbank Accession No. AA122242
  unsure (1)..(564): n = a or c or g or t
gcgacatgtttagaaatactggtagggaaccaggagtaagaaaagctttaccagcttttactacaaatggatgaaagacatcaggatcccaccaccgcaagtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgttcttggcattttttttttattaaagaatccagtgntcaaaaaaaaaaaaaaaaaaagggg

SEQ ID NO: 71 - DNA, 584 bp, Homo sapiens
  Genbank Accession No. AA122302
  unsure (1)..(584): n = a or c or g or t
cagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattctnggaggacttagttattcattgccaggacttacagacagcagagcattacccttgttggccaatgattctcagttacagaatttgccactaacctatattcttacttgtcaacatgatctcataagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagtnggctggataagaattttaaatatgtgatgtgtatgtatagcccctactagtggatggnatttgtgaaatta

SEQ ID NO: 72 - DNA, 261 bp, Homo sapiens
  Genbank Accession No. AA127946
  unsure (1)..(261): n = a or c or g or t
ttaaagtgaaagaaactttattttgagtaatatacatatcattcattccatttaattttcatagctatgcnctatgaaaattaaatggaatgagtaatatacatatcattcattccatttaattttcatagtgcatagctatgtgtagaagtacacagggaagaataaacattagaaatacctagccatgaaaatatacaagtgaagacatttgatatatccatggacnggcttggaagtattataaaacaggatccatta

SEQ ID NO: 73 - DNA, 444 bp, Homo sapiens
  Genbank Accession No. AA130349
  unsure (1)..(444): n = a or c or g or t
tacaaaaaacaattgttatttgtgtacttttaaaacctcacagtaatattttcacactaccttcttggctgaaagttcacactcggaattccagagcagtccatggccaggcccactggntccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttccaaactgtgtacaattgaagcctccgctttatagctcttagcacacctctcaaataagaagg

SEQ ID NO: 74 - DNA, 616 bp, Homo sapiens
  Genbank Accession No. AA131322
  unsure (1)..(616): n = a or c or g or t
gatttccatgcactttaatgaggtccagcactcaggaggattagcgcccaccaccagctgcctgggcaggggagggccggagcaggtngcaggcgtcaggcttaggacagggaagggggctcaggatggggaagggtcctcaggacaggggaaggggctcagaagagagcagggggcttaggacaggaaggggcactcaggacggggcagggaaggtgtggggggcagtcgccacctgggtaggaagcagtggtgttttggacaggaggggctggctctccagtgacccaggtggacaccccaggcctgactcacggctttttggggacatagtggtggatccagtccaagtagtaggtgacacgggtgtagatgccaggccggttgggctgggcacagctncgntcccagctgaccacgcccgcctgtagccaggtgccattcaccttgcacaccaggggccctccagagttcgccctggcatgagtccctccggtgttcccggcacacagcatgtcgttcacggatgatgccgacgtcgtctcccgtgtaggcgccaaagtggtatttgcgtcacaaatgtggtttccattatggggaccttcactgcttcagg

SEQ ID NO: 75 - DNA, 464 bp, Homo sapiens
  Genbank Accession No. AA131919
  unsure (1)..(464): n = a or c or g or t
tttttttttttcctgagtaattttttattttgtgcagagacaggatccagaactcctgggctcaagtgatcctcccactttggtctcccaatgtgctagaattacagccctgagccacggccccatgccccgtttttaccagtgtatattttctactggaaaatgagacttttagggatgaatgtggacttgtctgttgaaacttgtaaatttgcttaaaaaaaaaaagatctccaagtcttcacaaaattttatattccccaaggctgccccatcacaatgcctgtgaagcttgactggcagacactgaggcctgaagctgggggctgcagggggtcactggctcacccggtccccccgtaatctgtaaaacatactgggtgagggaggctgctggaggacctgaatctctcccttctccaggcagtagtgaggcatatgctgntggccttgggccaattaaa

SEQ ID NO: 76 - DNA, 417 bp, Homo sapiens
  Genbank Accession No. AA132239
  unsure (1)..(417): n = a or c or g or t
ttttttttttttttttttttttttttttttttttttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatcnccaatatttgaattatatggcagggttcatttctgtcttttaagcagtgcccactttcccacttctttttggnaggaaatgcagttcttananatttngatccagcatgtggacttttgactccacaccaaggggcatctgtctcaatcattaatttttcactaggaattgncttcaaaacttccaaattagcttcagttttcag

SEQ ID NO: 77 - DNA, 467 bp, Homo sapiens
  Genbank Accession No. AA132453
  unsure (1)..(467): n = a or c or g or t
tttcaaagggtacaaagaagtttattgactatgatgcagtaaagataccaagagttacaatatttgtgcatatggcccaacagtgcctaccctcctacaaaacaaaaacaaaaacaaaaaaaggcaatgaggtgcagcagttaacagcccaacactggagtcaaaggaatggagctgcctcttctggcagcaaagtttcaagttgtgcaattaaataatagtcttggtccactccttgtgggtcttcttacagtttccctttagaaccataactgagtgacttagtagaacattcatattcaggatgtggcctccagaagtgtcgttttgttttgttttgaacaaagacgtgctaccttctctcttgaagcaccagtgctgggttcaggagctacagaggactaagatgttccccaagtagcctggaagtaacaggtcacatgggaaaacacaaagcaattggtgng

SEQ ID NO: 78 - DNA, 393 bp, Homo sapiens
  Genbank Accession No. AA133756
ctccatttattttattttatttttttataaaaaagcaggcataaaatacaattacattactacgaagatgcaacaaaattttaaaaaagaaaaaggggtgcaatttttttcagagaggacagctgatcaaatatttataattttctaaaccatgcagttcattacttattacaattccaaacaaaactcattattatggggatgggagtcagggagaggcccccccccaagcatgatatccagcgctgtcacacagtgcttatgttcaaagtgcttacaaatggtgtcttcacagcatagggaagctgaagccttattccagggaaggagaggtgagtcagtagcagtgtccaatggcagactcagaaagctcggcagtgacttgctcaaaat

SEQ ID NO: 79 - DNA, 398 bp, Homo sapiens
  Genbank Accession No. AA135870
aaaatttaaaataaaattttattttatcttatactcaagttcagacaatagcatgtggtgtacattcaaaatttttgacaggtacagagcacattaaaaaatgaagacatgatcaaggagatgtaagagacaaatagacaacaacattctccctgaatctggaaaaaagcaagcaataagatcacgaaaggcagctgtaaaacaggattattctgcatgtgttgcccacaactagggcaaggttatctctcatcacaagtacaaagccattgatgttagtgtgtaacagagagaaaacagaggatttgtacagctgaggaaataaatggcagatgttacacaggaagcaatataacatggtcattaagtaactgtattcaaccctcaaatttaatttt

SEQ ID NO: 80 - DNA, 390 bp, Homo sapiens
  Genbank Accession No. AA135929
  unsure (1)..(390): n = a or c or g or t
aaagatatcaattatatatgtatataaaaaaaaaacctcactttccccacaaaaagcacaatactgttatcacaaaaaaaatcatcatcctcataattaatcatcctagccacgcaggtgtntttgctgccaaaagatgggacgacaaataacgttgaccaggcagaacccctagacaccctcggcccacccacagcctctccggctgccgaagacgagggacgagggcaaggcagagttctctgaggtccccaggccttcaccccatctgtcagtctgtgtcttctaggacagaaggtagttgtttttttttcttttaaaacgtctgttcaaaataaaaaacaaaagcacacgcgcaagagaagcggggaggaacggaggctgcctgcg

SEQ ID NO: 81 - DNA, 439 bp, Homo sapiens
  Genbank Accession No. AA136864
cacacagacacagaatttatttctggacgcattctgcaggctggaggtcccggcagcacagggctcacaccttgggttttgcaaacacctcccagccctccagccggcccatcttgaccagggaggccgctatgccaaagtacacgcaggcggcggcgcaattcccgtagttgtgcgtgcgtgctcccagagtcaggcctccgggcagcacccgaggaagtagttcagggggtcgtcgggcttctcgcggacatgggcgctgatgcaggtggtgaggccaaacacggccccgacagcagctgcagtgaacgtgtattgtccaaccttagccactccttcaaggaaggtgcccggagatttgagtgtgactctgtaggcagcggcggtcaggccagcgacgctgaaaataactggtggtgctgtaggctttgcggtggca

SEQ ID NO: 82 - DNA, 511 bp, Homo sapiens
  Genbank Accession No. AA142858
ttttttttttttttttttcaaggggaaactggggcagttttattgacgatggcaatgtacaagactccacacctaggtatgtgcacgaggtaaggcctgagctcaggccttatgatcctcctcaggacccttgggggcaaacttctcctgcagtttcttccacatgcctttatctatttccttaagctcttccaaggtgtctgtggacaggatcagcttgtactcttccaacgacaggccactgaagctggtgtctctggggcgagggtacttgtgtttgtagtagtttgaatggagtcgcgctaagtctcgtacatctgatcacaggcctcaggtctgcaacctgggtattctctccctcccgaaaggcctgtgctacccgctgtcgcaggtaagcgcccaagtcccggccccgtttggtctcgtccactggccattcctcacagagcttaagaaaacgccggtaccgtgggccgccatttgggccccgcgtgttcccgcccctcgtgcc

SEQ ID NO: 83 - DNA, 434 bp, Homo sapiens
  Genbank Accession No. AA143190
tttttgaacatgggaataggttttattttcatctcaagaacatttaagttgggtgaagaaattcagcttttgttgttagaatctgacaggcttcaaacacttgtgatggaggggttgttgtcatatcaaagtccacctagtaaagttttaggtgaccagtgactttgtcaattaggtctgctggtcctggcccaatccctaggacagtttgagagcctggtgcaatctgagtacgtccagcatcttgaattaaacttacagtcagtcccagcatttttgcatgggccaataatgcaatcagggtttcttcatcaggagctttgaccaccaccttgggctggccacagtattcccattgtttgagcatttcaggatttcttctttgaatctgcctgtaggctgaaacagcagcatgagagcactgggcagccact

SEQ ID NO: 84 - DNA, 599 bp, Homo sapiens
  Genbank Accession No. AA143467
  unsure (1)..(599): n = a or c or g or t
gcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggaggggggcatgaagcaggaggacaatgcaataatttgaaatttccctaaagctggccagtatctatgcttgcgcagaacagacaggaatttgctgttgctggctatgaattctgcatttcaactctagaggaaaaaattgaaagagaaaaggaattagcagaagacattatgtcagtggaagagaaagccatacccacctcctcttgggcatgtgcttagacgcctgtgctcgctaccttctgttctccaagcagccgtcacaggcccaaaggatgtntgaaaagctctgcagatttct

SEQ ID NO: 85 - DNA, 341 bp, Homo sapiens
  Genbank Accession No. AA147224
  unsure (1)..(341): n = a or c or g or t
aatacattttcacagtgtgctgaatgtctttatttacaagatatcattctatagtgaatatgaacaaaacgaatgtgcatggttgaaataactgcttgattaaaaatgtgctgtgaagatgaatcactaatctttctaatgcactctgataacacaataaacatggaaaaatactaatcccctaatagatcnaaatatagnatatagnccccnaaatatttcngggggatggattttccttcngaggtttcncaaaaaggnaaaanggaaatggnttcccccagccaatggtttagccaaatattgggggaaatgcccattccaatgggaaaaacccggat

SEQ ID NO: 86 - DNA, 546 bp, Homo sapiens
  Genbank Accession No. AA149051
  unsure (1)..(546): n = a or c or g or t
agaaattagtttattctttattatcacacagaataacaagaattagagttaaattcacaatatttttaaagaaaacattatgtgaagatgattcatttcaaaccaccagccaatttaacataaaacacttgtcaagctgagtagactgttttcttatgtgaaccacaaaatattttctctgaaatctacacttagtttaaaaacagagatgggattttgcatattagcttgaaaataagtatatgatgatgatattaggtgcccactagcacctagtttttacagctttgcattgtcaccccatcactgccagggacccagccccaggcatacacagatgaaaggacagtttcaccttcttggcaaaaaccttcagaacaattgtcaacatactctcaaatgtctttcccactcagaaatgaggagcaaggtgtatgacnttagattcaagaagtatatggggctaaatatctttaaaagtttaactctgggacaatgtacttagggacctactacttactccaaataggggtagtagccattagt

SEQ ID NO: 87 - DNA, 561 bp, Homo sapiens
  Genbank Accession No. AA149579
  unsure (1)..(561): n = a or c or g or t
atagtaaatatattacatttattctaaaacttcaaaattattctgtttttgtagtactgaaaaaaagacagtgccatttgaaacaacagatgcatcttttatacattttcacaagtttgtttttcatatttttaaaggccccatttatctgtaacagtggtatttttatttagagtatcggctacttaatatatacatgcaacaatatatgctttaatagtcatttaacttttaggaatatttcatcacattaagtggttaagcatagtgttaaaagagtggaatttaaggaataagaaaatattgaaaatacgctgttattttcatttgttcactataatagaatgtttttgcccataaaagttatcattgcccaactgaattcctaccaagaactaacaagtgattctcagtggggagaantttntttnntnngaatatagagggctcgttagaaagtgcagatntaggcgggcgcgtantcacaccgtaatccagcacttggaggccaggcgggcggtcacgangtaggagatcgagaccatccggctacacggtgaa

SEQ ID NO: 88 - DNA, 420 bp, Homo sapiens
  Genbank Accession No. AA150920
  unsure (1)..(420): n = a or c or g or t
agcgttgtaaggtttatttgggtagggaaggggacaagtgaggtaactgatccttgctttgtagacagtgcaagacaattatttgtggtgaagggactgtatgccaacaaacgttactcatgctttagttaaaactttaagtcacctaaaacagaaacaattctnaagaacactggtggaaaatagaagtgtaaatgtttcagacaaaaccaaggcattgtcagcacgatgtacattatacggcagatannacagccacatcctaggccacagagcagatcccaagagccccaggcatgcaggagagttttaaaggaacagacggaaattttaactgtgaaaaccacgaaatttcatgacttttggtcagctacnaccccaactaatatatgaccattaagagtaaaattctgaccttta

SEQ ID NO: 89 - DNA, 426 bp, Homo sapiens
  Genbank Accession No. AA151210
  unsure (1)..(426): n = a or c or g or t
tttttttttttttctggatgaatacatgttctggtcttgttacaggttctggtaaatcagatggagaaatgttgttgcagaaatgtcagcaaactttacagcagtagttcacacatgcagctactatacattcattcattgctattttcctaagaaatggagcaacctaggagcttatgctacagtagattccaatgaaccataatgactacttcaagaacaaagaagcacatncaaaggtgtgatatcttcctgttggtttgagttttcaaacctgaaattctttaaaatacatttctgggattttatttaaatattgatgcnacacacctaaaaagcagtgacttcttgggtaaaatgtaatactgaaatggaaaattgtcttttcaaaaaaataagaagtgtggtttggaaattccccgtgcc

SEQ ID NO: 90 - DNA, 400 bp, Homo sapiens
  Genbank Accession No. AA151428
  unsure (1)..(400): n = a or c or g or t
cagagagaaagtgctttatcagccgggctcagcccgcacacggactcgccaggagtaggtggtcagcacgcgctgctggcggcnaccacgcaggtgtaggtgccctcattgacggcgttggcgatgatgctcaggtgcgcctcgcccagggccaggtagccggggtaggagaactccaggggctcctggtccttgtaccagtacactttccctttcttgtggaggatcttctggccgcagcggaaggtcacgttcctgccctcggnaccaagcctggttttggtcctggggggcggtggnggtggttggccaccgtggggaaaggggaatttcgtagcaagaaantccgcaagctngcttgggggcaaaaagcttcctttccantgaagncccgccggga

SEQ ID NO: 91 - DNA, 502 bp, Homo sapiens
  Genbank Accession No. AA151544
  unsure (1)..(502): n = a or c or g or t
caggacgagctgtgggggctgcaccggctctacggatgcctcgacaggctgttcgtgtgcgcgtcctgggcnggaggggcttctgcgacgctcgccggcggtcnatgaagaggctctgcccagcagctgcgacttctgctacgaattccccttccccacggtggccaccaacccaccgncccccaaggaccaaaaccaggctggtgccgaggnaggaacgtgaccttccgctgcggccagaagatcctccacaagaaagggaaagtgtactggtacaaggaccaaggaagcccctggaagttctcctaccccggctacctggcccttggncgaaggcgcaccttgaagcatcatcgccaacgccgtcaatgagggcacctacacctgcgtggttgcgccgccagcagcngttgctgaccacctactccttggcgagttccgtgtgcggggctgagcggcttgaataaagcaatttctctctgaaaaaaaaaaaaaaaaaaag

SEQ ID NO: 92 - DNA, 285 bp, Homo sapiens
  Genbank Accession No. AA152200
  unsure (1)..(285): n = a or c or g or t
tactcttccctcctcatttattttggaatgtgctagaaacagcttgaaacatccctttaatagcttcccggcctcacgagtgttgaatgacatgacgaattctccttcatagaaggtacaggtgaaccagaactggaggggcatttgggatccttccttcttcagaaagtgcgatcgcatcaagatgcatgtggttttcagtagaactggcccatgtttcttgggagcgaggtgtccaaaccactgttcatccatatttccnggatgatttgctcccngggctca

SEQ ID NO: 93 - DNA, 473 bp, Homo sapiens
  Genbank Accession No. AA152408
tgattctggaaatattttaattaggttccactttaaaaaaaaagtagcttccttatgacctccacagtgagtacattaactacattttcacaaacagaaaacttacatacattcaactgtttacaagacatgtctccatataacacatttacattcatgtgaaatctatgaacttctttaattgcatatatttatgactcttacatctggtaccttttaaaacagctaacatatagtatgcttatttcctataagttaattaatatatgactatttaaggtgagaagagtctcatttgaagaattacaatagttatattcataccatgggaaatcaatagtttttctaaacataaatttcaagctaaagctttagcaatttaagttatttaactaccaatgcatgaaattcttatcagattgtcccatttggattacagtttaagtcatttcaagctgttcacaattatttgg

SEQ ID NO: 94 - DNA, 528 bp, Homo sapiens
  Genbank Accession No. AA155958
  unsure (1)..(528): n = a or c or g or t
acccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagtactcgttaaagttgatgccaagacaaaggcacantggatgaatggaaagcaagaagaaagcttctaatgggaatgcaaggccagaactggnactaatgacgataagagccttgatgagaacaag

SEQ ID NO: 95 - DNA, 379 bp, Homo sapiens
  Genbank Accession No. AA156064
attactataccatttatttgatgaattaatcaatgttcaaatggaagaggttttgacaatgtcactatgtttgatgtttatacctgccctgaatgcttgctcagaagagaaacagatttcccagtattttttataacttactttcccattgtcttcaattaatttgctattatcccaagtagacagacaacttcagtagtagccatctccctacatttttagatcactgaaaaaaatggatgagcaacccatgaaaataactagcttactgaaatgcttgtcttttaaagaaaagttgggattatttaaaaaaaaaaatggcccaggaccagttagctaggagatctgggagagagaagtcattgccttggttctgaca

SEQ ID NO: 96 - DNA, 457 bp, Homo sapiens
  Genbank Accession No. AA156565
atagtaaatatttaattgtttccatcagcaattccagcacaagttttcctggatggtaggcagaatcaagctacccaagggttcatgatgaggtatgggggtcactgaggagacccccagagtcactgacccctcccgccacctccacacaccaggtggccctgcagaatgagggttgggctgatagaatgtcaattaggggagacaggatacagggtgagggaacagggtctagcttgtatatttgcctgcaggaaggagggagggcaggagagactctgcatagaaggactggaactacacatttaagttttcaaccccaatatgcagggggaaacagccaagccactctccatctgtctagtattaggaacctctcttcaagtggtcttttgtcatctctgttcttcttcccaattctgtattccagattccaaattctacaattgaaacccaa

SEQ ID NO: 97 - DNA, 428 bp, Homo sapiens
  Genbank Accession No. AA156897
cagacatggaaatataattttaaaaaatttctctccaacctccttcaaattcagtcaccactgttatattaccttctccaggaaccctccagtggggaaggctgcgatattagatttccttgtatgcaaagtttttgttgaaagctgtgctcagaggaggtgagaggagaggaaggagaaaactgcatcataactttacagaattgaatctagagtcttccccgaaaagcccagaaacttctctgcagtatctggcttgtccatctggtctaaggtggctgcttcttccccagccatgagtcagtttgtgcccatgaataatacacgacctgttatttccatgactgctttactgtatttttaaggtcaatatactgtacatttgataataaaataatattctcccaaaaaaaaaaaaaaaaaaaaag

SEQ ID NO: 98 - DNA, 418 bp, Homo sapiens
  Genbank Accession No. AA158132
tttttacaattccataccaccaccacatctgttctgtgcttttattttacgaaaaagctaatggcaaatctacattaaactaagttgaatacaaagtcttagtgaagaaggcctggtggtctcgtttacaaaaatggccagtgtcatatttgggcttaaaatttcaagaagggcacttcaaatggctttgcatttgcatgtttcagtgctagagcgtaggaatagaccctggcgtccactgtgagatgttcttcagctaccagagcatcaagtctctgcagcaggtcattcttgggtaaagaaatgacttccacaaactctccatcccctggctttggcttcggccttgcgttttcggcatcatctccgttaatggtgactgtcacgatgtgtatagtacagtttgacaagcctgggt

SEQ ID NO: 99 - DNA, 602 bp, Homo sapiens
  Genbank Accession No. AA158262
  unsure (1)..(602): n = a or c or g or t
ggtcgagctcaggttctgcttgccgggtgcccagtgaagccgacagagcctcgagtgcttgatcactcattgtatccttctccacctttcttttcttctcttggggtggagcagcacttctgactgtccctgctgactgagcttttaaaacttctgtagattcctctttttcagttttctttccagcagctgtaggcgacccacaggtgaagtcagatgacaaggcgtctatagcatcatctggccctatgggtttagccaatagttccctatattttggaggaattgtgacttctcttttacccaattcctctatgtaggtggaactcattggatctgaaacttctggtccagtatacgttgtattttcttcttcagtttcttcaggtcctcctaaagtatctattaagtcatccaaagcagcatccatgcctgactttcccgatggtttatccggtttagattcaactggcacagctggggttaatgatttcttttcttttttcttgtcanccggcttgcagatattgcagtgataccagcaacantctctccaccagcagaaatcatgtcttgtgggttagtctttgggtcnggtgatt

SEQ ID NO: 100 - DNA, 392 bp, Homo sapiens
  Genbank Accession No. AA159025
ttgatgtctagaaacatcttttatttgggtaacaggtcccaaaacaggtcagttaataaaatagattctaaagaatatgtccctatgcacagccctccctccccaaaaataacgctgggggtaggcattgcctttcccccttgggctcctcgggtgtatttaaaaaaatgttttggcagctcagtgtttatcatctgggcatgggacaccatgtccatgtccccatattcctagggtacagcagcagtagatggctgcaacaaccttcctcctaccccagcccagaaaatatttctgccccaccccaggatccgggaccaaaataaagagcaagcaggcccccttcactgaggtgctgggtagggctcagtgccacattactgtgctttgag

SEQ ID NO: 101 - DNA, 478 bp, Homo sapiens
  Genbank Accession No. AA165116
tagtgttaaattttattgaatgctttctccgcatctgatttttcttctttaatatgatatgtttcattaatattctgatgttaagccttatattcccaggataagcccttcttggtcatagtagaggcagtgtgtctgtgtctgtgtgttttgttcagtatactgctggattcagtttgccagtatgtttgcctagtacttttatttaggatttttttgcatgtacattcataagaaagattgatctaaaattttattgtattgtccttttccagtgtttcaggacaatatcatagcctcataaaattaaatgggtagcttcctgcacctcttaccttttttctttttcttttcccttccagagacatgatctcactctgtcactcatgctggagtacagtgctgtgatcatagctcactgcagcctggaactcctgggctcaagcatcctcctgccccagccccccaagcagcaggg

SEQ ID NO: 102 - DNA, 472 bp, Homo sapiens
  Genbank Accession No. AA165231
  unsure (1)..(472): n = a or c or g or t
tttttttcattcatcagacattttaatgagacccaatctgatatgaccccttcttgggggtagctcatcatccaaggagaaacaaacagttacaatgttacaatgcaacttgctaaatattgaacagaggtaattacataaagctgtgttcccccagctgctcccctgcttgtgctgagatcaggagagctgtaggaaggagccacaggggtaaaggatgacccactccagctgttggaatatgagatgagtcacatctggaaattctaatttggtgcagctgcccaaggcaaagtggtaggccttgttcacatttaactcggtaaagctttatgaagcacctacccagtgggtgccatggaggtggatcagattgagccacgctgctgccacctctgtggagggaggctggcatggatacaacttgatgactatagactcttcctctctgggnttcagttccctctttcta

SEQ ID NO: 103 - DNA, 476 bp, Homo sapiens
  Genbank Accession No. AA165312
  unsure (1)..(476): n = a or c or g or t
tcgtnncntcggttctgagaaataggcactggcaatttacacatgccttgctgtgtaatctcactatatttgctcaggcaaagtgggagaagcagccttaggttttcattctagagatgccggctttcccacctgatcggcttagagttcacgattgactgttttgggcttcatttcaccctctacataacaagcgggtggactagatgccttagcaagggtccgtgttgtgtggtgtctccagccacgcactcagctcaatcttagcacagttaaaaaatgcctttctagcaagttatctgcccagtgcctgaaaaagtatcatttcttgtgttcaataaaaaagcctcctaatttaatcaaggacctatggagataactgtcttttagttgtggcattgcaaggatacaaatgcagagatattttaaaagtgatccttctgtaagagtgaacccacgatatgatctggnagcaa

SEQ ID NO: 104 - DNA, 479 bp, Homo sapiens
  Genbank Accession No. AA165313
  unsure (1)..(479): n = a or c or g or t
cacaagcccccacgtccatagccaagttttccccggtttcccagcagccagtgacttctgtagcattaggattcttatagtagttattgtctacatttctcagcagattgaatatgtactgcctcttactactggactgtttattcttaaatgtgtacagtatggatttatgtcgtctatatattatgcatttatttgtcttcttcgttgtgatggtaagctcctggagggcaagtcttgcatccactgctttgctggcaacccgactggtaagcttctggaaggcaaggcttgcatccagtgctttgctggcaacccgattgctaagtaccgtgttttaagcttagttcagtctcaagtgtttgcagccacatctgaagaccaataaagcaactgctgggtttatcccntgggagctgacagaatttcctctcccaaataccatanacaggaaaatcataagcctgaattacccggtg

SEQ ID NO: 105 - DNA, 347 bp, Homo sapiens
  Genbank Accession No. AA169837
tttttttttttttcagccttgacagcaacaccctttattcagcaccaggaatacccttcgcacagaaccagcgagcttcacgtgctcagcttccccgcggaaatgctcacaggatgctgcgggacccccggcgtgccacacgatctagtggtggtgctgtctgaactggagcccacagtaaccgcatgtgccggtttttgtttctttgtccaagtttatatacacttttgggtggccaagagctcccccgccgccatcgcacgctatcacccgagtctccacctcgctcacgggctgctctgctatcaaatcaatggcaaagttttcattcacctctttctgacgac

SEQ ID NO: 106 - DNA, 298 bp, Homo sapiens
  Genbank Accession No. AA171939
  unsure (1)..(298): n = a or c or g or t
ttttttgaggcacctgtgggactttattaggtaaacagaccccagctccagccacaggttggaccggccagctgacagtgcggcctcagacacccccgccaggttccctcctccctcctctctcagggtcaccagtgtgtgaaagatcggggcatgccggccacagggggaagcagggttcaggctgccccacctgggtctggccctggcaggcgccccctcacctggctctgctgtggganccgagaacaaagacatnacctgcctggctcctgctgccccggggggtcagcnagca

SEQ ID NO: 107 - DNA, 420 bp, Homo sapiens
  Genbank Accession No. AA172188
  unsure (1)..(420): n = a or c or g or t
atttaagaaagaaattttactgtgtctttcatacacaaaagctgattaacaatggttaaaaaaacactactccactttttcacaggtgtacaaaaggaaatataatggaattacattcaacaataaagcttaaagttcactctaggtaatagttgcattaacattcacatacacaagcacagagtaagtatatttcaggagtcttagcatagcatacagcatacatatgggagattgatttcaggtaacatcataggtgttagtaagattagcaattcagagtgttatagaaaaggaaaactaaaccaaagagaaggtgtaggctagcacaccaagacaagtcacagaattagtagattgaaaaatctgctcactgtatgagaaaacaatatttttcctcnatttttgggtcntgatatn

SEQ ID NO: 108 - DNA, 596 bp, Homo sapiens
  Genbank Accession No. AA173223
  unsure (1)..(596): n = a or c or g or t
ttttttttttttcagccaaattcatatttattccagtctctaacactctgttgttatgtctgctgtaagatgatcaggagttagtatgaagtattcttctctacgcaccaaagaaaacaaacaaagcaaacttcaagtcagtgaattagttaccacagttaaaatgcatttgattttgtccttttcctttttcacaagaacgacagctgaatactctttcatgtgatgcctgatatttttctttttctttttctctcttttttgagacagggtctttaagatggggtctcgctctgttgcccaggttggagtgcagtggtgcaatcttggctcattgcaacctcagcctcctgttttcaagtgattcttctgactcagcctcccaggtagctgggattacaggcatgtgcaccgtgcccggctaatttttgtatttttagtagagatgggggnttcaccatgttggccaggatggtctcgaactcctgacctgaagtgatccacccgcctcggcctcccaaaagtgctggggattaccggtgtgagccactgtgccagctctgatggtgaaaatttcnggtacaggcctagcccan

SEQ ID NO: 109 - DNA, 408 bp, Homo sapiens
  Genbank Accession No. AA180314
ttagcaaaaacagcttttttattgtggtagtttgtggtatgtgctcctggatcatgcagaaaaaaggctgggcctcagttagctccgggagccattcttaggaccctccggctgcacacagagaggggctgggtagctggctgggctggggcacgcattcactgggctggcacaggctgaggggtctctcgcccactatcattaggcccctccagcccgttatgctcagcccccggctcaggatgctccagggcgtgccgggtatcagcctgccagagctgcaccaggtccgtcggggtctttcctgccaggttcttggtcatcatgtcagccccatgcaggagcagcagtttgatgattttgtagcggttgagcctcacagcgtcatgcagggcagtatccctcgtg

SEQ ID NO: 110 - DNA, 479 bp, Homo sapiens
  Genbank Accession No. AA182030
  unsure (1)..(479): n = a or c or g or t
atcatcataaaaaatatttattataaaaaattatcacatttctctgtacatagcataaagacaaaaacacaatgtatacattaataaattaagtgggcctgagtattcagtatccatctactagaatcctaaagctcttccccagatttcacaaaggccaatgtagattatttctattttatcaaagttcatttgcacagttggtgtaattgagatactaacatttcttttttctagtgttttaaagatagttcacagtatttgagttaattaattaatcaactgatttaaatctttggtaaatacaagtatttacatgtaaaaatgtttagctcaaatttcagtaaaaaactggaaatgaccaataacctactgccaactgttttggtataatccagaaatgcatgagccggactcccaccattaagaaatggcactgtcnaggacctcngatgataaaactggaatccncaaaaaat

SEQ ID NO: 111 - DNA, 313 bp, Homo sapiens
  Genbank Accession No. AA182882
  unsure (1)..(313): n = a or c or g or t
ttctggcacatgattgagcatttattgcggcactaacagagggtgctgggggccccaccatccttgcctctgcccttttcacctccccctccctcccagcttcttctgcctagagcgttccagattcccctcacattttcctggatcagggccactcctcccaggcacctcttgccctcaccagtaccttttgtcccttctcctggggctgagggtcctcagctgtgctggnccccaactctccacccttagtgcccactgtctctgccaccctccctttggaactcagggggctcaggcatcctggcctctg

SEQ ID NO: 112 - DNA, 258 bp, Homo sapiens
  Genbank Accession No. AA188981
  unsure (1)..(258): n = a or c or g or t
tttacactttactgagacaattttattcactatggatatatatacatgatcaacattttatcttcattcttcagaagacttaattagagtagctttcttctcatacttatctctaatctctttaatattttccgagagatcttctgacatgcattcntcatattctctatcaactttagcaatctgctcctcaagatgtttctctacagacccaacatgtgtagcaaccatctctaacagacgttgcaagttaatttc

SEQ ID NO: 113 - DNA, 417 bp, Homo sapiens
  Genbank Accession No. AA189015
ccagtgtactatttatttcctcaagtgcttccatgggggaaaaaataaaagtctaatatgccagagaaatcatcattgaaccaataagacacagtaacataattctagtaacctacttctcaatgaacacacatctgagaaaaaaaccgccagtattttattctcatggaaaaacagaacaaacccacaagttggagtcacggagataaaatacagatgaaatggaaaacggtctgttgtcatgaactctcactttcaaataccattttatatggaagttactttactgcggggcaaacagaaggccatgctggagtctcttacttttggaaaatggagaatcaaaaatttgctaatcaacaaacaaaaaaggagggaaactcctttggtaaagctctacaaacataattatacatt

SEQ ID NO: 114 - DNA, 506 bp, Homo sapiens
  Genbank Accession No. AA189083
ttttttttattccaaatgtctttattgaaacagaatgatagagcaagaaataatgaggtctgggtggatgtctttgggcgcaggatggagcccagacccagtggttacagtgtggagctctctccctgtcccctgactctggccaaggaagtgaatgcaaagcagcagggaggaggcagggtggggacggccctctgagctctccgcgatggctggcgtgaggtgcctctgagacttctgggcagccctgccttccctactcagtcttcccgatcttcttgccacctttctgtgtgggccagcctcccgccagtaactcagaggccgctcagagggcagggttgggggtggcaagcagcgggacgtggtcacagcgggtagggggtggctgccgcagcagggaaggccggcgacacagctccccgtcccggagcacctcgggcaggagcttgcgcttggtctccggaagcagcataatgctgaagaatgcagaagagggcgcaagc

SEQ ID NO: 115 - DNA, 484 bp, Homo sapiens
  Genbank Accession No. AA192553
  unsure (1)..(484): n = a or c or g or t
ttttttttgttcttactcccacacctaaggtggaanttcttttattgagtcataataatttcccgagaattccgagtcctgctactttaggttcttgcccaggaatccacctcttttcccccaagcccaacaatcctttgaggtactcatgattgagcgcgtggtgggggggggtggggaagaggctgcatgggggtggggctcctgtggcttcacgtcatccactgtcacctctggtccccaagtctctggatcctttggtctcacctctagacaaccggcggggttcaaaccttcttccctggcaactcctctctgtcccgacaaaatctctcccaaggcattgtccttgtagttagatttacacagagcttttgcttttataaagtgcgttcatgcccagcttctcacttgcatgtcatagcacccctggtgaggtggacagggaagggatggctccctccattttgtaggaaagtngggg

SEQ ID NO: 116 - DNA, 513 bp, Homo sapiens
  Genbank Accession No. AA193197
  unsure (1)..(513): n = a or c or g or t
tttttgaatttgactacttttacttacaagagacttttccccatcaaacgatttccccatccatttattacacttctgaagtaggatttctgaagtcatcttatggcatgtaattcttagtataatgcacaggattcctgtcattttgaagcacgaggagaggtttttgatatcttaaacatttttttagtgtagatgcacatattctccacttccaattgtaatagaaaatcagtttaaggataccctaatgatgcaaatgaaatgattagcaaacaactcaaatttaggagccttctttacaatccattgagtgaaacagattcacaaaataatttgttcaactgaagatttaatttattattagaaaatggttttaaactctgatcattacattgaagagtcaatgactgaggttttcttacctactggctcatctcttagacaataacttcttgaataatttcnacatgagtgtctgtacaagcttttaaaaaaccgaataaattaaag

SEQ ID NO: 117 - DNA, 499 bp, Homo sapiens
  Genbank Accession No. AA195678
  unsure (1)..(499): n = a or c or g or t
gaaaatttgcctcctggtaaccctgtaatggatggggcccagaaatgaaatatttgagaaaaacaagtgaaaaggtcaagatacaaatgtgtattaaaaaaaaaaagcctattaatagggtttctgcgcggtgcagggttgtaaacctgcntttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacg

SEQ ID NO: 118 - DNA, 512 bp, Homo sapiens
  Genbank Accession No. AA196549
  unsure (1)..(512): n = a or c or g or t
tttaaaagtatcaaataattttattatgaaagataagccatttattgaccattcacttttctaaaaaaacacaaatgtgagaataaaataaacatacctaagactnactggcccctccaggacaggaagcagccctggacangagagcctgcaaacggagttnccttatgnnnaatgtctgaacttctcatacattctaggatttcatgtttcgttacaaaggaaaggaaactggctagaagattcatgtacaagaaggtcacaactttaaagctatctgacgctaatgacttgtacaatctggtttgcaaactctgagagacagtatcaaataagcactgttcaaagactactcccagctaatcctttactgtcattttctctttgaaattgtctttgggactggntatgtnctcactgtagcttccgtttatcccacagccccaaanccctanagtcccatggtgcagtctccatgttcaaggtataaaagtctgttttcaggacaangg

SEQ ID NO: 119 - DNA, 463 bp, Homo sapiens
  Genbank Accession No. AA197112
  unsure (1)..(463): n = a or c or g or t
aaagtataaagtgttttggaaaaaaaggaaaaaaatctatataaaaatctcttcacatataaaatcctgaagaaggtgcaaggtgagacccagtgcgaggggcgtgctcagatatgcagtgtgtgtgtgtgtgtgtgtgtgtgtgtatccgtgtgtacatgtgtgcacgtgtgtcgtatgtgtctgtgtgtctgtgtgtgtgtgtgtgtgtgtgtgtgtgtgtgtggtgggtgcaagtgcacgtgtggcccacagagggtggggagaaagcttggctttttacttccatccaggagggaaggagggcggctggtcctccagccttggagggtctgcagctgggcgggacctctactcagccaggctgttgcgcatcgactccttctcctggagggcggccatggcaagacgcaggtgctccttcagctgctcgatctcccgctcagaccgtgtctngatgtga

SEQ ID NO: 120 - DNA, 512 bp, Homo sapiens
  Genbank Accession No. AA205072
tacatatagtacaatttccagtgtgatgacatttcaatgggaaaaagattgtgcatttgcaataaacaccatcattcctgagtccacagataaggtccccggagaaggggcttcccctcctttctcgctgggttgacgttcccagcgagtgaagccttttctggaatgtgtgtacgcaccctccaccaagagttctaataagctaagcttaaagcagaacagtgaaatggcaaaactgtacagagccctgactttacatttcactctgacagccagggtcggaagcaccacatggaaagtgctgtccataactgctcacttacctgctccttgctgacagctcccaggatctggctccagagagtggcaaaactgggaattttgccaagggaaattactcaggaccgctaataaaaacgccggcttctgcaacatgcatattcccccagcccccacctccatcttgcccagggcagaccattcattaactatctgcggggtgaacaaagaat

SEQ ID NO: 121 - DNA, 404 bp, Homo sapiens
  Genbank Accession No. AA205376
aagatttgaattttttttattatcccagcaaacattacactagagaaaatgattgggaaaatacaaataagttcattaaaaacacaggctgattattcatatctattacattcagaattatgcgaaacaattagttatattgcaaagctgtaattctttttctaacaaagcatgattttataaaactttaatgttgccactgattcaattttaatacaaaatacttatatacacaatacaatataaaagtaaactgtgtagtgccttccacaaagggatatattaaggcgctttacaaatataccaatattttgacccaaattactttttgctttagattaaaatgaacaggctaaatgttccactttaaataccaaagggatggtttattaaaaattttttat

SEQ ID NO: 122 - DNA, 282 bp, Homo sapiens
  Genbank Accession No. AA205460
  unsure (1)..(282): n = a or c or g or t
gattttattggaaatacggatctagagctagtggaagaagttatatttaggagtcatccacaaagaggcttgagaaacaaatgaaaatgtattgagaagtgcatagagaacaatgttnagggggctgtggggaaaaaacaacatttggaagataactgaaggaaatcatagaggaaaaatagtacaatctaatttttctccctaacctgaaagcaaaaccacttttaatactaagantttattatgatctctccatgatactaccattttttcaatcccaac

SEQ ID NO: 123 - DNA, 523 bp, Homo sapiens
  Genbank Accession No. AA205724
  unsure (1)..(523): n = a or c or g or t
cccattgggtgacagcgtttattgaaaggaaatcttgctttatccaggaattcactcacatggaggtagctgcaaggagaatgtctctttctcatgacaaccaaagcgaccaaaccataccctaaagcagagacgcaatggaataagtcaacgggcattgtagaacgacactcagaagcaggaaaaaccataaaagatacaggatgattgtctcttcagtattgcatttggccatgtatgtgtttttacataaaatatatgttttctttttaagctagctaaagaaaatactcttgatcggggttagttcttaaagcaaaaaacagaagaaaagtatgtatatataatanaattaaagaacgatagcatgttatacctggaaaggaccgtgggcactaatctgcactttgttccaggtaatccatggctctgagagtgagcacactgtcaaagtcactggggtgagatgagccgggacttggaaaaccctctcttaactttcagtctcaactcctcccactcc

SEQ ID NO: 124 - DNA, 449 bp, Homo sapiens
  Genbank Accession No. AA205947
  unsure (1)..(449): n = a or c or g or t
tttttttttaaacataacaagttttcttattctttattagtttaaaggaagctagaacctaataacaatacgccacatacggttcagaaccaaacaaaagctgcttagttatttattttgcatttgcattttgtaggaagtgagaaaaaaacagctctattgggactcaagtttattttcaattaaaatccccataaattaggaaatgtcttataaaacggagaaattggaaaaaaatgttattcagaaaaaaactttcttgagtgtgcttgtttcctgtagcaccttggattttgtgatcagtcttttaaagatattttttaaaaaattcaacctctgtcttcacatttaggacagggcataacagtgtcttgtcctttcatgcaaataagaggnaaaatttatacttgcntagtttcgagcattgaaagcactcgccccaattctgc

SEQ ID NO: 125 - DNA, 416 bp, Homo sapiens
  Genbank Accession No. AA207103
acgatagttacttttgttatgtattttaccacaatttttaaaaagcaaaccaaaaccaaccaagagtgcttcccccacacctcaaaatcatcctgcagcagctccctggcccagctctctctcaccctgaccctgggcccctctcccaccacccagggctagccctgtggaccaaccatctctgccagcccctccccgaccctccagccagggaggtggggcgctggccggtgaatggggcaggccaggcccaaaggctggccaagggctcaccagctctggactgggcgtcccgtctgaggtggggatgaccaacatgccagctctgggttttagcttgaggatgggcacattcaagcactgacagccagcaagcttgggcacagggcgatgcttaacctttaaaaaatcgggta

SEQ ID NO: 126 - DNA, 437 bp, Homo sapiens
  Genbank Accession No. AA211300
  unsure (1)..(437): n = a or c or g or t
ttttttttttttttttttttacaatctggaatatataattttnattagttctcagcagtgcagtaaatgaacaacacttattaataattaatttgggagagaatagcaggaggaaaaatataaacagtagctttttgtgaccatttttaagtagctgacatctcagtatgtttctggaatgaacaaattaagggtgtattgtatatagtgatttaaataatcagctttcttatagtcttatcaactgagattataaaattgtaaacacaatttttccatgtttacatctactagctttcatttggacacattaaaccatacttttccattatgtagttaattcatttcttgagtgcctgcctgccattagatgccaggtgcttatctaattttccagttagttactgttcagcttaagtcactctacttggttggtn

SEQ ID NO: 127 - DNA, 587 bp, Homo sapiens
  Genbank Accession No. AA211443
  unsure (1)..(587): n = a or c or g or t
catttagtcaaatatttatttgaactcatacaaagtttagtgacataatttaaaaggtgaagaactaaaacgcattccaaatattgaccaaaatactgtaggaagtagcttgggaaacttttcatcaaaatcgttaggcacattgccatatcattctccataaaatcatatccctcctcaaaaccacaccctccaggtgttgaatttatgggctaatttgttctgtgaggtgccaaaaatgaagataaagtaagaaatacagccaactagaaggaagagatataaatgtacaaacaggccatttctgctagagtctcaggcattcaggaggttcacaatcatcatacaaatatataaaattttagtgagctattgaatccatcttctgcctctttatttcttcacatcaatccttttttcttcctactactggtcagctttggggacatattttaggttcacttttaatattctggatttccgatagattgactgcaggnccgggaggttcctcgctccnggaattggcttcttctcctcatccgaggtgggaggacaccctcctccacttcgggggacattctttt

SEQ ID NO: 128 - DNA, 348 bp, Homo sapiens
  Genbank Accession No. AA211835
gttgtcacgattttcatttagcgtttgccaaggctgccattgcaagacacaggagcgaaggggttgatctctaatagccaaagtgtgtgacaaatgagaattgaactgtgtcccagaacatcctcccgccctacacatagaaacctggggtcacctccctgtcctcgactcactgtgtgacttcaggcagaggtcaccaccctctctgggccctttcattctctgctatggactgagtgggaccagcttggatcaaaatcctcaaacctcatacaacactgtcagcagcttttcctgtatctgcctgttacctgaactattaacagttttctttaaattggctccttt

SEQ ID NO: 129 - DNA, 382 bp, Homo sapiens
  Genbank Accession No. AA214688
gtttgtttggtggggttacacggggttcaacatgcgtatcgaaaagtgttatttctgttcggggcccatctatcctggacacggcatgatgttcgtccgcaacgattgcaaggtgttcagattttgcaaatctaaatgtcataaaaactttaaagagaagcgcaatcctcgcaaagttaggtggaccacagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaatttataatgaccagtttaggaaaataagagctca

SEQ ID NO: 130 - DNA, 477 bp, Homo sapiens
  Genbank Accession No. AA215379
  unsure (1)..(477): n = a or c or g or t
actttttagtagagacagggtcttgaaatgctgcctaggctggtcttaaactcctggcctcaagagagcctcctgcctctttttttccttttaaaataagaactatcactgttttcttctccttccttttttttttttttttttctctagcaactattgccaccctggccccaaaagttatttatagagtacattggtagtaattatacttacaatttagtccatggagtgcaggaccatgaggaactatagctagataagattgtgccagaattagaagaatagacattttactttcagagaccatgactaaaagaatattaacaccaagatgctccttccatcagctggatgtacctttgggcttggaaagatggcaagtataggagttgtactggaacggctggatcaaataggttgaaggcatttttgtcattgtacatgtggggaaaagcaaccaagtaataagacnccacn

SEQ ID NO: 131 - DNA, 398 bp, Homo sapiens
  Genbank Accession No. AA216589
cacaaatttaagtttggtttatatattttattgacatggttactcaatgtccacatcattccatctgcatcgtcttcctacaaacagtttttcttctactattcggttatttctcctttttttgtttcctatttcagaatcaaatttattttacttgcaaagtcagtggaatatggtttggaaccagtagggcctctaacttaagcccagaacctgtcaaagagaagtgcagtatcattgctaagacttgaacagtttatctctcagaatcttcagttcctttgaatttctcagctcttagtgtaatctgttttatgtgtttgttgtagacttccatttatgggatagatttccaaaataattttgggtaatccaactgggtattttagcattcccgg

SEQ ID NO: 132 - DNA, 378 bp, Homo sapiens
  Genbank Accession No. AA219100
  unsure (1)..(378): n = a or c or g or t
ttttttttttatgcttgaactaatttattgatgagattctcatttctgtagtataaaaggaaaatattttgcagttatctcgtatttgaaagactttgccatagagaactttatcagaaatggatgaacttttcattatttcttataagcatattggttttggcctgcttgagtttaaaactttttttggtagacntagaatgttaatatttagataaagaaaatattttacngaagacattaccagaaagtaaaataacttgaacatttcngtattagcncnttatcagagaataacatttattttatttggaaagttttccnaaatatgagacnatcngcnatttctcagacnaagtgaaaaatttaataaaatag

SEQ ID NO: 133 - DNA, 444 bp, Homo sapiens
  Genbank Accession No. AA219304
  unsure (1)..(444): n = a or c or g or t
gcttgggcaaaagtcttcagaacaaaggctgtgagcaggtgttgccctggttcctgccatatcgctccccaaaggtgctgtaggagccatcatagtgtttgtagttcaactgtctctggtaaccagtgttgagatagccaatggcttggacttgacctctggagtaagctgctgtgtttcatttagataatccagtacatagatgttaggagcaaagaggaccatattctgctctccacagccatagggcatctggagaagattttgtgtgttttgcatggcagagctacatatgtctcccaaaactgagacagaagctcgggcagattcttctaccacatttggtggcagtttcagggataattcttcagaaacctcancacctgntggacnaagtagggagttgaatgttgtttccttctctagtccttcaggttcaaccaa

SEQ ID NO: 134 - DNA, 341 bp, Homo sapiens
  Genbank Accession No. AA219552
  unsure (1)..(341): n = a or c or g or t
tttttcagtcatgattggtttaaaagtttaattggagacnttgccggtggnnaacaaaatganggcatacaactgtcacaggcagggcagtaagtacaaagtctagctgtaaaaaccgtttgaaaatataaactcgtttttggaatacatgtgtcaaaggctgcccatgttaatacctttggtataaaacggtaacgattcccttgacaaacccatccatcacctgacgcacattcacatctcctggtaactactctacctagtctagtctcaaccacccctgtcagtcacgactcactcctgttcctttgcaggtgcagaggagcctgggaggtaggtca

SEQ ID NO: 135 - DNA, 323 bp, Homo sapiens
  Genbank Accession No. AA227926
atgtaaactatcaaatgtttatttaaatttccatttaaaatattttcaagtaaaatatgtacaaaaatggttataaaatggttgaagcaactagaagcgtgacaggtataatacatataaatacaaccaaaattcaattcaatgcaaagttgaatgacatcatattgcaccaaaatttattccatacaaaagcacatgcatcaagagtttccataagatgaaaacaaacacacttacttcatagcatcttaccacttacttacacaaatagcccataaacaccatctggcattgtgattgcagtaccagaactctccccagag

SEQ ID NO: 136 - DNA, 469 bp, Homo sapiens
  Genbank Accession No. AA227936
tttttttttttttaaaaacagaagcgcgaccatttctttattaaattatacaaaagggttggggaggggggcagctgtggggctcggcacaccccgggccccaccccggcctggcgctgtctgagaagaggggatctgagggagatccagggatcaggcaggatagggatggggcaggacatgaggctgggggatgcagaggttaggtgggagaggctaccggagtaagaatgaggctggtaggggagggagaaagagagcaaagagagagaggagcaattgggggccagctggagagctcagatggagcaggtcaggaggtggaacaatggcagagtgagggtggagggcgcagtgtctggagaggcggaaatgagaaggctggggagaaagaagagggtggcagctctggtgcagggcccagagcagggagccaggtgaagagtggctggactttgctgcccccacc

SEQ ID NO: 137 - DNA, 328 bp, Homo sapiens
  Genbank Accession No. AA228020
ctacttcgcttccgttccttacttttgcttctctttcgttcatgactacgacttctgctcttgctttttttcctctttttgctacgttcttcatggccgttggactgctcaacttgttctcatcctaagcagggttgatagaagaacatcatgaggacgaagtggtaacatttcaagttgtcaaagggtaaagggaacaggaataagaaaatacaaaacaattttaaaactaattatttacttatagtttaacatggaaggctataaaagaatttagatgggtatgtgtttaaccactttgttgcttacatttaagtcatcaagatac

SEQ ID NO: 138 - DNA, 462 bp, Homo sapiens
  Genbank Accession No. AA232266
atttttctactttcttttaatatcattttttaaagttggtaagcagctagacatcatttagaagcagacgggttaaaatagacaagaaatagcaaagacacatccttcacatcgtacagaactgtattagtatccaccaccaccatcacaggggagggctagctgtcactggggtcaggagtactctccattattgtgcaggggaccagacagcatttaggtgtgacgatgtcaaactgagtggacatagagagtgccgggatcaaggtctacagttttggctctagacttgcgtgagggttggttactcttaatctcttccaggctgtgctggatcccatagccgaagtagatagcaaagccaatcagcatccagaccccaaatcgggcccaggtaccagctgtcatctgcatcataaggtaaatattcacagagatgctcattagtgggaggagaggcaa

SEQ ID NO: 139 - DNA, 401 bp, Homo sapiens
  Genbank Accession No. AA232508
gagggtacatcgggggagaggagaggagaggagagcctctctgtgccttggtttcccatttgtgcattcagggcctctgcaggctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgcgcgtggcatctcataaattcttattgagaatggcacaggtattaaaaaagtttctgggtagtctacgagaaatgtcaattattatctctactacaactacttacatatatctaatgggaaaa

SEQ ID NO: 140 - DNA, 387 bp, Homo sapiens
  Genbank Accession No. AA233347
gctgcaaacatgcagagatttcatttattttgtttggcacatgggaactacattttgttcctattatctgtgtgtttcactttgctgtgcagattttcatccaatttttttcaggggagggcatatacatttgtagggctgtatctatccaattctgcctgtaacaaacacccaaacatcctaaaatatcaattataagacagacaagtgtaatgtaaaactctggagaacatcaaagaaaaatggccatgcatctgctctttaatgttttcctacgatatattaaaataaaaacaaagtttcagtctcttcacaagaagtaatttatattctctgaattttttcagccacaacaactggattctcttttctgatttttgctgcagc

SEQ ID NO: 141 - DNA, 182 bp, Homo sapiens
  Genbank Accession No. AA233545
tatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggag

SEQ ID NO: 142 - DNA, 243 bp, Homo sapiens
  Genbank Accession No. AA233854
tttttttataaaaatgtgttttattgttttaaaacaagtctataaaagtagaaatcacatacaaaaatacagattactctgacatgttggcaaaatagcttatggctggacttgagtttggaagttctgtatgtttgagggcatccgatgtcagagtccaaccggatcctaaccccagctcttgtcactaatctgtaaacaataatttcaagtagtatttagcactttttaactattaagaaa

SEQ ID NO: 143 - DNA, 217 bp, Homo sapiens
  Genbank Accession No. AA233935
tcaaaataacataaatcttttattgaaagtcactttactaatgttacaatgggagtaacatagaaaaccatggtatcttattagcttccgaagtgaatactaataaaactgtgccagaaatttgaaccttaagttacagtgacctttaaaaacatcaagattttgtttacctacaatgtaagaacaattttataacttgaacagccataaaacaaat

SEQ ID NO: 144 - DNA, 403 bp, Homo sapiens
  Genbank Accession No. AA234095
attaatgcaaacatatttttattaaagaatgaatgcatttatgctaaagaatagcttacatatgttgtaaagcaacaagcatatcttcaagaagtgagtcctcctcaatatgactccatgcttattctacatgcctgaaaactgggcccacacacaggggcacacgtacacgcacacaaacgcagatacggacacacagatatgcagaccgaaatgctgacaccatcgctctctagattggattagctctcatttaaggcttcttaggtgccgcagtgcccctaatattaccaggattgaaaacagacttttaggaaggagcagcattacttcgaaaagtagtcatctgctcttgtcctccaatgtgtgtattttaacaaataccatttaattctatgttgac

SEQ ID NO: 145 - DNA, 103 bp, Homo sapiens
  Genbank Accession No. AA234634
cagctcacgcgggacctggccggcctcccgagtctcttcaagcagctgcccagcccgcccttcctgccggccgccgggacagcagactgccggtaacgcgcgg

SEQ ID NO: 146 - DNA, 185 bp, Homo sapiens
  Genbank Accession No. AA234831
ttttttttttttttttttccaattttaacatagaactttattgaaaacacagactcaaatagagaaccatatatttaaacaacgaatagcagggtagcttacttaggtgacacagttcattgaaaacttaatactgaaaaataccgcaatctggacagcaagacaaatatcaacaaatgtgtttt

SEQ ID NO: 147 - DNA, 291 bp, Homo sapiens
  Genbank Accession No. AA234996
  unsure (1)..(291): n = a or c or g or t
ttttttgaagcttcacacctttattgtgtccgggggcgtccggggcctcaggggtgttcgtagcccgtggcgagagggttcacgtggctattgtggaacagagtgtggttgccgtccccccaggggtagggcttggtgcggatcggagggtgttggtagggacggaactcggggcgcgggcggtggccagnantggagataggtagttgaaggtgcagagggccacgctgggcagcgcagcatcgaaggtcagcagacgccaggtacgagctcctgctcctccgtggcctt

SEQ ID NO: 148 - DNA, 139 bp, Homo sapiens
  Genbank Accession No. AA235310
tcaacaaatatttattgttcatcaaagacgagccagattttatgggcatttgtgatggaggctggccttagctttaggagaaggaactccaagagcagtagtgatctctgagatcaccttgttcaccctcctcggggca

SEQ ID NO: 149 - DNA, 382 bp, Homo sapiens
  Genbank Accession No. AA235618
acaatttaataatttattacattacagtggcatcacaccagcagtcaataaggccactctagggaaaaatctttcagtatttccatgacacattctgtttacaataattcataaactggtaaaattcattctaagaaaacttggcaaatgaaactttggactggaattggcatttctttctctgcttttcgttcccaccatttctttcttttatactacagtattcatattttaaaatgttttaaattatttcagaacattaagatagcagttacattttttaatagttatattattttaaaatgactctttaaaataaagttttagagaaactatattatggatagggctgatttacattttcaaattttctaaaatcagc

SEQ ID NO: 150 - DNA, 175 bp, Homo sapiens
  Genbank Accession No. AA236241
ttttttttttttttttttcggcggtcaacgcgctttattccgaggggcttcagatacagatgaccccagccctgcatccgcccggaagcgtccccttactcccatggggcacctcgataccagctgccctgccctgactcacttctcagcacccatcttacggcagtcggccctg

SEQ ID NO: 151 - DNA, 519 bp, Homo sapiens
  Genbank Accession No. AA236286
tgctttctttttctttttttttcaataaacaaagttttctcgcttctgccacaatagtaaaaccatctgatcttgacaagataatggtgtcgttgactttgcttttttcttgtccgttggacaaaattggccaagaatataattggactgttatgaccaataaaaacgaagtttaggtcaagtcttgtcaggatagcctgactaaaaacatctggctccttaatttaaaatagttcagacaaccagattcttgctgtgttttatgttaggttaacacgctgaactttaagaagctgtagactgcagtttgttgttatgagacctgctagctttgaagcctttcaatttctgtacaaagaatgattcgagaacttctgcacactggtaaaatggggagtcacttggattgtagtaacgacagttatcaaaaattttggtcatatctgccacaaattccgtcagcttttcataatatcgtctttgtactctttcttccatgttggcaaggtccataggttg

SEQ ID NO: 152 - DNA, 539 bp, Homo sapiens
  Genbank Accession No. AA236453
agattggaccaatctgaagtgggcaattataatggttatactgaagattatataagagtatcattgtccagtatttacaaaagaaaaaaataaaaatataacctatgggatgttagtccattttgtgctgctagaagggaatacttaacactggcaaattaatacagaaaagaggtttattagcctcagttctgttggctatacaagcatgacatcaacatctgcttaacttctgatgaggcctcaggaagcttttatgcataataaaaggcaaaggggtatcatggcaaaagacaaagcaagaggaatatcagttttttgtttgtttgtttttgtttttaacaaccagctttcacatgaactaacagagaacacactaactgcagtggtaagaacaccaatccattcatgagtaatctacacccatgacctaaacaccttccactagaccccgcctccaacatgggggaacacatttcaacatgaggtaaggcacaaaaaaccaaagcatatcacataaaaaaaacctccccaagttg

SEQ ID NO: 153 - DNA, 401 bp, Homo sapiens
  Genbank Accession No. AA236455
tttttacgaaaccaggtttattaaaatttctctacaagtcagaaacggccatctcactgttcacatatatacacgtatgtacaggaagaacctagtgtttctagctttcccggcagaaggccctgccagcccagagtccttagtcggataatgtatcacagatacaacagtcgagcaaccacgagagcgttagtgcgacagaggcctctgtcctccctcttctcaaagtcccatgattctgtcaaggtaatattgccaataatcattcacatttcacgtggttttagacacgcaggttattcagacagacacagacaacaaaacaagcctcaaagccagaacaaaacaaaacaaaaccaaatcgaacataggtataaaaggtaaaatatatgtacaaagta

SEQ ID NO: 154 - DNA, 533 bp, Homo sapiens
  Genbank Accession No. AA236476
  unsure (1)..(533): n = a or c or g or t
ttttttttttttttctcatcactgagtatttattatatataacaaatacatgggaaagaaaaaactatattgtgtgatataaatagtttatttacattacagaaaaaacatcaagacaatgtatactatttcaaatatatccatacataatcaaatatagctgtagtacatgttttcattggtgtagattaccacaaatgcaaggcaacatgtgtagatctcttgtcttattcttttgtctataatactgtattgtgtagtccaagctctcggtagtccagccactgtgaaacatgctccctttagattaacctcgtggacgctcttgttgtattgtctgaactgtagtgccctgtattttgcttctgtctgtgaattctgttgcttctggggcatttccttgtgatgcagaggaccaccacacagatgacagcaatctgaattgttccaatcacagctgcgattaagacatactgaaatcgtacaggaccgggaacaacgtatagancactgtagtcctttttttcacagtg

SEQ ID NO: 155 - DNA, 403 bp, Homo sapiens
  Genbank Accession No. AA236477
tttttagtttggttttgattttaaacattttattattgaaatttcaaacacatacaaaagtagaaatattagaacaataagtctccatgaacaaaacactccacttaaattatcaacatgttgccaatttagtttccagctctctttgccaattatttttcttttgctagaatattttaatccaaatgtgtctatcttcatttcatagtatgtatctcatatcatacgatcttttattttttataatcacactgacataatccctaaccaaattaatatatgtaaatatcatttaatatttagtccatgtccacacttccctcactgtctccaaaatggctttttatgttttgttcaaaccaggtccaagtaatgccaacatactgaatttagttgatatgtc

SEQ ID NO: 156 - DNA, 308 bp, Homo sapiens
  Genbank Accession No. AA236545
tttttttttttaacgttttcaaaatctatttttatttttcttcagtattacctgctgttcccaagtggctgggtaatctatgggttatattttcatttaccctcaaagctaggctgccagtggaagctaagaataacacaattaaattcaagtttctctagaaaatatgacaaatcaaattttaagaaagtgtaacttgtggttttgctttggttcaagatggctgatctgagaatatcaaagcatttaattcaaactaatagtgtgtcctcatcctaggactagaaggtaatttttcttttaaggag

SEQ ID NO: 157 - DNA, 534 bp, Homo sapiens
  Genbank Accession No. AA236822
cagatattatttaaaagattaattaggatgtttatttatttattttgtagagatggggtttcactatgctgcccaagctggtctcaaactcctggctttaattaagtgattctcccacctcattctcccaaaaggctggtattacaggtatgagccaccacgcccaggcttattttaatttttttttaaatctaggaacaactgttaaacctatatacttactacttgcagttccatgatggcaaatgactgacagaagatcatatgtcacaatttgagctggactatccttagcaagaaatggctgaagatccaagccttctagcggaaatgaaacatgggtactgattttggtggaaaacattagttcatgtctgaatcttttaaggtggatgcacaaatctcaggaaagttttgtactttacaaaacttcactccatttctcagctttttgcatttttcacaactgtacatattgtcaccttttagttcatctctggcaaagaaggcagcaagacaatcttgcaaggttac

SEQ ID NO: 158 - DNA, 471 bp, Homo sapiens
  Genbank Accession No. AA237011
tgcaaacaagatccatttagtggggaagaggggactattaaaagctgctagaaaactgaataaagcaaatcaagactgagaacagttccaactcccatcaatctccaaacagtgacaggtcggcagcaactcctttcctttatttcttccccttgtaaagggaaattcaagttcagcagcattcctttcctgccccaagtcctcaaccagacaagaggctgcaggcaccaaatcttgggctggataatggcaaaggcctcagaagctcacctccagctctgagcttcaacagctgtttgtaccagtgagtcagcattaaatccaccagaaaagaacagcaccacccaaagactggggggcagctgggcctgaagctgtagggtaaatcagaggcaggcttctgagtgatgagagtcctgagacaataggccacataaacttggctggatggaacctcacaataaggtggtc

SEQ ID NO: 159 - DNA, 548 bp, Homo sapiens
  Genbank Accession No. AA237034
tttttttttttttttttttttttttttttttttttgacccgggacttctttcatttcctaagcaccgcgcatggtggtggcactagctccccctccaagatgtcacagaaaacagagcaggttggaaattagaccacaatcactcccaagtgtcttcacagttcagacaggcaaacatttcaaaaggcggcctctgggcccgcctctctctttcacacacacacacacttgcaggctgtgggaatgctgttcagccactgagcgtggctggctcatgtcaggtactgcaccacgaggaacatgaccacacaggtcagcagcatcccacctatcataaagtacttgtcctggaaagcccgcttctcgatgagccgcatcactgtgttggacaagcccagcatgttggcaatggtaaggatcttcttctgagtccccttcaaggtcagtctctgggtcctcagtccatctaaaatattgtggccatctaaaatgaggtcatccatgccgttgggaccttccggaaggaaggagttaaactgcagtgaatt

SEQ ID NO: 160 - DNA, 439 bp, Homo sapiens
  Genbank Accession No. AA243416
tttttttttttttttttttaagattttcatagggtttttaattttttgttgttttttatacaaatactaaaaagtattctttatataactgcttcttccatccataaaatttgaaagcttctctgtataatatagcacaatggaggtggttctgatcaaaattttactcctattttccatttgatttagcatttaattgtatattaggattgccccgctcggttatgctggtgatatcagaccccactacggcttggccagtcacatggccatgaaaaatagacttgactgaattgaaaaaactggactttccagacccaactggacccaccaaaagaatacgaatttctgaaaccaagtctgcatagggcctatagtctctgatgtctgctagaagcctatttctgtgctctctggctttaattatcctctttatgtc

SEQ ID NO: 161 - DNA, 455 bp, Homo sapiens
  Genbank Accession No. AA243698
gagaatgtgagatttttaaaaacaaagacaacataattcaggttaactctgttgaacagtcaataaatgaaattcatctacacctgaataaaacatatttaacaattgaaaaaattttaaacaaccacaaaaagtaaaaactttaaacaaacatgaacaggatttgtttttagggcacacaaaggcccctgcagcagattccaacagtagctttactggtgtgtcttctacagatgagttaaagagacaggctgagctccacacaggcaagatgactaacagggcgacaggacagtcacacagggcggagtgccacacccggctataatccccagattccactgcagagctggctttgtgcgtaggaggcacacaaagaaaggtgattcaggcagacattattcaaaagctacttcgtcgtgtaaccattgaataatgtttgggaaagctttggg

SEQ ID NO: 162 - DNA, 358 bp, Homo sapiens
  Genbank Accession No. AA243763
tttttttcagagttggaagaaaatgtttatttagcaaaaaggtatggagtaaaattggtagaatagaaaggagaaattagaagtggggaattctgagaggctgttttaaaacatggtaactgggaaataattttgacaaaattctcataggtaatgaagcttcatatgcccttactgcctaattaaaaggcacctaataaccaattttatttgtattaattgtattgggaataattttctctaaccttctacctttcataaggaaaaatacaatccgtgaacacctagatggttctgttttcactgtatggcacaaagtatcaatgatttaactgtggagagtagtatcaagtagaga

SEQ ID NO: 163 - DNA, 297 bp, Homo sapiens
  Genbank Accession No. AA247204
agatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtatttt

SEQ ID NO: 164 - DNA, 342 bp, Homo sapiens
  Genbank Accession No. AA248555
attcgttgaaggacaccagctgcggaatttgcggctttggcagattgaaatcatggcaggtccagaaagtaatgcgcaataccagttcactggtattaaaaaatatttcaactcttatactctcacaggtagaatgaactgtgtactggccacatatggaagcattgcattgattgtcttatatttcaagttaaggtccaaaaaactccagctgtgaaagcacataatggattttaaactgtctacggttctaacctcatctgtaagttccatgcctggagaagctaatgccacctaatcakgtgataattcaatttgtacaataaattatgacctggaaaa

SEQ ID NO: 165 - DNA, 377 bp, Homo sapiens
  Genbank Accession No. AA248802
gcgctttaggggaactgtcttcctccgcagcgcgaggctgggtacagggtctattgtctgtggttgactccgcactttggtctgaggccttcgggagctttcccgaggcagttagcagaagccgcagcgccgcccccgcccgtctcctctgtccctgggcccgggagacaaacttggcgtcacgccctcagcggtcgcactctcttctctgttgttgggtccgcatcgtattcccggaatcagacggtgcccatagatggccagctttccccgaggtcaacgagaagagatcgtgagattacgtactataggtgaacttttagctcctgcagctccttttgacaagaaatgtggtcgtgaaaattggactgttgctt

SEQ ID NO: 166 - DNA, 458 bp, Homo sapiens
  Genbank Accession No. AA250850
ttttttttttttttttattttttttttttttagcaaagaaaaagaacttttatttcttcagtagtttctaatgcagacaaatgtgacaaggcagggagctgagctgaccccaagccgaaggtcccgactcctctcgggagcctggaggagtcccggtagcgaatagatcagatgcctcatcctcgttcaccccaaaaggctgagaccctggtgtgtcctcctcgaggaccctccctgtttctgggtgctagaggccgttgctgtttctgtgacagagggatggctttgggagctccaaagaacctaaccaagtttttttaagaaattcgggggacgaagcaataaccgcttggcccccttgaaagtttcgttcaaacttttttcaactgtaaaaaactggttaatctcaaattgtaaaaaaattttttccccccttattttgaaaaaatgcatttttt

SEQ ID NO: 167 - DNA, 410 bp, Homo sapiens
  Genbank Accession No. AA250958
cagttgcaagatttaatagagtgaaatagagtgaaaacagagctcccatacaaagggaagggacccaaaggcggttgccgttcgctggctcgaatgcctgggtttatattgcaatccttgtccctcccactgtgctcctcaggcaatagatgattggctatttctttacctcctgtttttgcctaattagcattttagtgagctctctgattggttgggtgtgagctaagttgcaagccccgtgtttaaaggtggatgcggtcaccttcccagctaggtttagggattcttaatcggcctaggaaatccagctagtcctgtctctcagtcccctctctcaacaggaaaacccaagtgctgttggtgaggttggctgatgaccactctaactgcttcctgctgaactgggg

SEQ ID NO: 168 - DNA, 372 bp, Homo sapiens
  Genbank Accession No. AA251769
ttttttttttttttttttttttttttttttttgatagccaaaagcaatttattatagtttagcctcaaaaaaataaaaataaaaaaattatccagtggttatgaggagtctaggaaaacctgtcccagtaatgccaacttggaggtgaagggctgactggggcagctgagaagtgggaccttctgtttggcaggcttcctctcccttgcctggtcatggttttctggtgagaagagtgttcctggccttgctggaggttcccatggccccgaactaacagtgtttttctgaaatttcgacctgctccgtttgagagagtagaattccctcatcaagtcctccacctcccactgctcttccttcagcctctgg

SEQ ID NO: 169 - DNA, 389 bp, Homo sapiens
  Genbank Accession No. AA252219
ccagaaatatttattggtcactttctgtgtgctagaaacattttttatacgatgataaatgaacaagactgacaatttcttgcccattaagggttacattctaataagcgataaagacaacaataataccagggagctgagtaatctaatacaaagcaagacaaagccagggtcactggaagcagcagtggtctttctgaggaagttgcagctgatcaccaacctgaatgaagtgatgtaatggaaaatagaagtgtttgaaggaagattgctttagtaactgaggaggagagaggaaagaggagaaactgcacaagtgggtagagatgggaaagtccatggcctatggggaaggtgaggaagttgacttttattttcaatgtgccgtg

SEQ ID NO: 170 - DNA, 281 bp, Homo sapiens
  Genbank Accession No. AA252528
ttatacttatgattagttttattataaaggatacaaatcagctccacaagccaaggaagacacagggaaaggtctggaagggtcttgagcacagtgctcccatgccccctcttcgtggaattagggcacactgccctgccggcatagccacagcttcaccacccaggaagctatgctgagctttagtgtccagagtttttattagggtttcatgatgtactgattaaagcactggccagatgattaaactcagcctccagtcccccgccccataggtcagg

SEQ ID NO: 171 - DNA, 412 bp, Homo sapiens
  Genbank Accession No. AA252802
gctaggttgaactggtacagttctgtgtgtactggtgaatcggactcatttctgcactactgaaggagagaaatggacgcggctttcgaactgctgtattccttccagacccgatagatgaggttccaggtgctgaaaatgaacaattacatacaggaatagaggcctactctgcacttaaaaatatcttcaaaaaagttgctggtcaaggagtatgcagcaatggtccttcctgttgtgaacattgagtcctagtgggtgaggtgtgggttgttactattaaaaatccttgttgtattgggcacaagatagactgaaattgactgtagtcctcacggtgagtctaattgcagcaacatgtgaaaaaggcaggcaagagctgagtcaggaaaatagacaagcagggtacctt

SEQ ID NO: 172 - DNA, 418 bp, Homo sapiens
  Genbank Accession No. AA253361
aaaaataaaatgtctctttattaaaagatataaagaaagtgaaaagccagccatgtattataagaagctattttattgatacgagaattaacaaaagtttaaccattgaatatatgaagaacttctacaaatatatgaaggaaaatgtaaacaacagagaaataaaccagcatctcacagaagagaaaatacaaatggaaaataagcacataaaatgtttagacttactaatattcaaaaaatacaaagtaagataaaaataaaatacccttttatagcttctaaattggccatatgaagaagtctggttgaggagaaaataggttaaaggaactcataagttgctgataagagtttgctttggaaaacaatttgtcattccttgtaaagttgaatatttgcataccctaagacttcc

SEQ ID NO: 173 - DNA, 326 bp, Homo sapiens
  Genbank Accession No. AA255480
gcgcacaaccaacagcgctcccgccccgtttttatttgaattcggagaaccagaggcgcctgcagattctggaggggtctcgcctgcccatcgctggcagcccgagatcctggggaggggatgccatactgctagagatgagggaagagagccccaagcaggaaaacattgatttgctgtacactcaaagggcatctcatgccttcagtccaccgcctcctcgggccacagcccgtgccctcgcgccggctcagactagctctggccctgctgctgtcgctgcaggttgtcgtcttcttcctggtggtcctcgggcaggggcggct

SEQ ID NO: 174 - DNA, 441 bp, Homo sapiens
  Genbank Accession No. AA255966
ggtggtttcttaaatgatttattatcgtattctacatgccaactgctttacatttcccagcagcaagatataggcttctttgggcatgttctgacatgtctgtctgagtgaacttacaccaagtaacattggccctcaggtcaaatttctacaattagtcttccaacacccattttttataatgtcacgtactcttcaagttcctagaaaacaccccccaaccccccccaaaatttacatatttaattactgaattgggttatccaacctgaatccaagaagaagccacagctctcatgtggtctgcctcaggcttatgggcagctgagacagcccatgactgttgtgtcccatctgtaagaagtagaaactcactggtcagtcaccaccattgaagaatactgtagctctacaacagcaaatgggcatgattttgatgaa

SEQ ID NO: 175 - DNA, 410 bp, Homo sapiens
  Genbank Accession No. AA256268
cccagcttttcaaaagtttattttaagtttggagactagacaaggtcatactggttttacatcctacgtgatataagtatatatacaaagaaaaaaacaacattggaatattacacagcttgaaggtttgcaaaggttatttgtgtcttagttatttctgcacttaatgacacatcagacgcattgagtatatttcataagttgttgactagcaaagatacaatcattagtaacccaagtcttcaaaattcacaccaaactttatgaagtcattcagaaagagaaagtcaatcctaaaattaaaattggcaactatgataaataccttcaaaaggatgtagatgtaatggagatgtttaaaagtttagtttcattaattgtaaaattagcatgttatatttactcaatat

SEQ ID NO: 176 - DNA, 355 bp, Homo sapiens
  Genbank Accession No. AA256294
acaactttaaaaaatggtttatttttttctttaacaaaatcgtacagctttctcaatccccaaattaaaaaaacagaaaacaggaagaaagggaagaaggcaaaggccacacgcacaggccggcccgcgtcacgcgcctgctggacggcacttcagggcacaacccacacgcgtctttggacttgcagacattccgcgaggcttctggcctctcgaaggcaaagcttttcagcgatttcattaatatttcattacgctgagatgagatgaaggcagatgctacagaaatatgtcagttaaagccacagaaacagaacagcttaagaagggctgggcgcccaagctcgtcacgaca

SEQ ID NO: 177 - DNA, 159 bp, Homo sapiens
  Genbank Accession No. AA256486
aatagaaaagtacccttttattgagaggtaagacaagtatatttacaatattcaattgttagataatataatctgacagtgggactttttaaagcagcagtatttcaggaattacaatttataaggggaaaagaaaaacattccaaatatgtttctgtt

SEQ ID NO: 178 - DNA, 196 bp, Homo sapiens
  Genbank Accession No. AA257093
tggtgttttttcaggccagaccagaacatttttattggtttagtcacttaggcatgctaaggtccccctgggttagggagatttcagccgtgagtgtgcaggtgtgcatgcacattagggggatatctattgggatgcagagaggtgagagcagctcttcagaagcgctggcaaaagaagaatgtgtattgaaacc

SEQ ID NO: 179 - DNA, 284 bp, Homo sapiens
  Genbank Accession No. AA258476
aagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctacgttgtttgctgagtcttctggctttcttccactcttcctgctcttggacatcagactccaggttcttcagcctttggaatctaggacttgcaccagtgggttggttgccaggg

SEQ ID NO: 180 - DNA, 423 bp, Homo sapiens
  Genbank Accession No. AA258585
taaataaaggaaacaatacttcatggaataattcatgaaaatttctctgactatacattttcaattttcatgtcaatatgatagaaatgtaaatgttatctcgatttgtacatttctatttgacttgcaaatttttgctcctttaaattttctcgtttggtatttttactctttcctaagtaaataatgatataatcgcataaggatcgactacatcttgtgtcctctcatctacttttaatatcttcctaaattattttacttcaaatctggttgtattgatgcctgtgagctgattgtttacatttctccccacatctctgttcaatgacagcatgtaggtagcttaaaataaccatggagtatttactccagggaaatcagaaaactccatagactagggctttccccgccatagagcca

SEQ ID NO: 181 - DNA, 319 bp, Homo sapiens
  Genbank Accession No. AA258595
ttttttttactcaggatcatgtttaattatgtaaaaaagctctaaagtcaggtaatggttttcatgtgcttctcttgagcagtctgaggagagaatagaaacagaaaccccttgggctctcagtagacgcagctggccgtgcacaggcagaggctctgggtaagtgcaggaagcagggtcacagccatcagcctcgaggtggggatgaaaggagatgacctggtggctgcgtgacagccactgtaggactctgatctcagggggacaggctgacacaggcagctgggaattctgggcagggacaagcaggcgttacaga

SEQ ID NO: 182 - DNA, 377 bp, Homo sapiens
  Genbank Accession No. AA261907
gcatttcaatagaactagctttatttacttatttatttatttaaacaaaagaaatggtttaaaagcaaatgcatatatgtaccaagggatggacatgacctggtacttacaaaggagctgctgtgtcataatggaaacagcatattaggagaaaaatagtatttcgtgtgctgtctgcttgagtaatcaatctggagatgcaagttaaccgaagtgcatctgccaagccatcagcgtgagaaaaaaaaaccaccagaagttgcctccagataacgatgtagtggcagcatgataactggcatcaactcacggtcttctcattttccccattttctataattttcctcttcttttcatctatttttttcttgaagatg

SEQ ID NO: 183 - DNA, 435 bp, Homo sapiens
  Genbank Accession No. AA262107
ttttttttttttttttttttttaggaagaattttattttaaaaattttcaaaatataaaaataataaacaatatggatttaacaaaacataattcaactataaataataaaaatgttgacaaccccacataaacatttaacactataaacattctaagcatacaagagtagtattctagttcaagttttatcttttttcagttcaagttttattattactttaaaaaaataaacaaaaaagctgctacagcttaaccaattgctttcgctccactcaaagagcagggaaattttttccccatgccaacacacattcatgaaatgggatacttatgggcacaggtatttaaaactggaacaatccagtctccagacaagaagactcctttggtgtttttcaattcaacagtccaccgaaattgagtttaaataaac

SEQ ID NO: 184 - DNA, 221 bp, Homo sapiens
  Genbank Accession No. AA262349
taagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatg

SEQ ID NO: 185 - DNA, 337 bp, Homo sapiens
  Genbank Accession No. AA262477
tttttttaaaattaatcaaccaacacccattctatttaaggttccaaaaggaagtagctggacccggctgcagacacactcccaccttgcttctgtcccaaaagtacatcccctacgtgtggttctccttaaacaattttaatgtctgggttggggaagcaggtagagcgcgtagaggcagctgctagaggctggttgctgactccaggccgcgttccaggaaatatcggtgggaagaacggggacgggcttgggacccttcattgaggaagtaggatgtgatcttcctgagtccctcctgattctcggatgctgagtcctcccatataacatcttc

SEQ ID NO: 186 - DNA, 281 bp, Homo sapiens
  Genbank Accession No. AA262969
tcagggctggaagttgatttttaatgataaagtacaatgaagggagggcagaggggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgccttgcagcttagccaagatatattcaaaaccctt

SEQ ID NO: 187 - DNA, 364 bp, Homo sapiens
  Genbank Accession No. AA278757
ttttttttttttttttttttttttcacagtccagtctttattagcattgggtccctggtcccaccagacacagacaaatcgccgtagaaaaggagtgggaggggcagagagaggggacccttctcccccctccacctccccaagcccctgccccaggtatgtacaataaataagattaaaaataattaacaagatgcgttttcccctcccacccgacgccaaatgccctgcggagggaatggcctttagcaaagatcttggcctgcaggggggacttggggggaaggggtcccccagctctctgaagccaccccaccccccccagccatacatagacttttcctatacattatgtacaaggtgg

SEQ ID NO: 188 - DNA, 181 bp, Homo sapiens
  Genbank Accession No. AA278767
atacaaaatcagatctataatttaatgccattttggttaattaaaaatacatgtacactggacactactacatattagggagcatctatgcaaataaaaggaaacatcaaattcattaaaatgtttacctatgaggtaggggtaagaggttagatatgggagtaaggactggagattaaaa

SEQ ID NO: 189 - DNA, 463 bp, Homo sapiens
  Genbank Accession No. AA278887
gctggatttagaaatgctaggtggccagttctggctttcatggtcattgctgaaaagtctgctgtcagtctgcctatggaccctagaagataatctgtcttttttctctagttgcttttaatatttcatctttggtgttcttcagtatcactaggacaggtcttagaatcagtttccttttatgcattctcgtttggcacttgttgggcttctgaatctgtggattactattatcgattagttttggaaggttctgtctttctctcttctccttctgggactctgattaaatgtgtgttggattttctcctacaggattttttctcttttgtatctttcatttcgctctctgtgatgcattccaggtaactcaccttaacctaccttctagttaggtcagcaaactacagcgcaggggccaaatccagctcactgcctgtttttgtaaacaaagctttactga

SEQ ID NO: 190 - DNA, 170 bp, Homo sapiens
  Genbank Accession No. AA279028
tttgaaattaatattcaatttattaaagttacaaacttcaaaataaattctgcctttaaacagaacttatacatctagaatattcatcagaaaattactcagaatattcactagaaattgttgtgtcaaaagtaaaataatcactttcacttggtctttaatacttagtt

SEQ ID NO: 191 - DNA, 419 bp, Homo sapiens
  Genbank Accession No. AA279313
tttttttttttttctttttttttttttttttttactgaaagaaaaaaaaatattttttatttcagttaatcgggaagctttgtcagagccctacccataaggagaagagacaacagctgcctttattcttgttggtttgctttgaatccgctccgtgtaaagtcagctaactctctcggtcacgggcgtccggctgtccaaaggctcctctctgtttggccttggaatggaggatgaaacaatgtctttgggctctccctcccctcggtgtttgtacttttctggggccgttgcggggtggcaacccggggctgagtcctaaccgggtccttggggcaaccgtcgctctccagtgaagcttctctgggcaacttctcctctttggaaaagctggtgctcaagtcctggggccagggggg

SEQ ID NO: 192 - DNA, 513 bp, Homo sapiens
  Genbank Accession No. AA279757
atttctgttgccatgttttttccagggcttccccgccccgttctcagagctcgcagtggatgcagtcactacaccactcccgggcttgtaacccatcacagcctggactcctttggtcaaagccctcacattctcttgatggaaaaaagttttgtcaacgatattttcaatctgctttgcttttttatttctgcctagctgcatttttatttcatcactgttcattttgttctctaggagtcgctggtgttgatgctgaaaagttacaggatctcttccaggaggaggatggcagtacagcagcttaccactgacatagtccttcaggatgtagcgcgcagatcgaggctggtctggctgtccatgcgctgtcatgaatcctcgcatgtatccataagctgtcaacagttcttccgatgttggaggtcggtggggatcttcatcctctctaggcgttatgatgttaatgccataggtagcttctaaaacatgtcttggaatattctggcaaac

SEQ ID NO: 193 - DNA, 256 bp, Homo sapiens
  Genbank Accession No. AA279760
ttgataaactgaacatagtatttattgaggtcaggatgcatgaatagactcttctcaacagaaagataattcaacagcaatcaatttacagaatttagaacagcactacatttcagcaaaatgcaactagagaacatcagataaattatagtaatttgtttttaaaaatccattaaactatctcttacctctgcaataatgtatcatacatgcagttacagaagttagtagggaaaagcatgatcttccttcccta

SEQ ID NO: 194 - DNA, 363 bp, Homo sapiens
  Genbank Accession No. AA279774
  unsure (1)..(363): n = a or c or g or t
aattatactttaagttctagggtacatgtgcacaacgtagngtttacatatgtatacacgtgccatgttggtgtgctgcacccattaactcgtcatttacattaggtatttctcctaatgctatccctctctttctcagcttccttagcggactgcttttctttcgtctcccaaccactgcctgagtgagctgattcccatgcaatttaatgtcatttttatgctgatgtgactgagcataaaatttgtatgactagtccagatctctttaaattccagactcacatttctgactctatgccacctccacttagttgtctcacagacatttcaaactgaatatgtcctaaataaaactctgaa

SEQ ID NO: 195 - DNA, 337 bp, Homo sapiens
  Genbank Accession No. AA279821
ttgacagcgtcatcaagtttattacacaattttcaacctatcagaaagacaaacaaatcaccgacaacagggggacgggaccttggcctttttgagggatgggtgttttttttccttttgctatcaggaaataaaactaaaaatggtgtcattgagtaaaaacaaaacaaatggggagaaaaaaattctccgggtaaacggcatttctggtattctatatatatttttccttaaactgtcaccttttctctacattttaaaagacacccggagttgctctcaataagcacatcacttaacacttggccagttgggtggggtgccatgttctgaagtg

SEQ ID NO: 196 - DNA, 306 bp, Homo sapiens
  Genbank Accession No. AA280297
tttttttttttttttcttgttctctgacaggtttattagctttcatgttaatggatgtttttaaaccctgcaaccctctgtcaacttctttccacatcaagaggccatgagatacagtaatggcctcttaagagtcatgccacataaagatgatgactttgatgtcctggcctgcctcctgtaacaatgtgaggctgttttgggtacatgctgtaataacaacaggactatcacaggaacaatgaagcagagaagcagaaggtgcctacaaagttttacctaaatgtcttgtttgtcaggatggag

SEQ ID NO: 197 - DNA, 313 bp, Homo sapiens
  Genbank Accession No. AA280309
gagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggctagaactctgccctcatttttcagtgaggaaactgcccaagacaggacaaatacttaccctaatgcttagcctggctccagtgaaattagctccccagccaaagctgagctggatggaactaacaaggacac

SEQ ID NO: 198 - DNA, 333 bp, Homo sapiens
  Genbank Accession No. AA280617
tttttttttttttaagtggagaacaaccaataaagagggacccctttattacacatttataaaataatagaatatagttattaaaaatgggacactttttttcatttttggtatcttgtattcagtttttccatcctcttcacaatcttccataacttgctttttgttatccattgttcacctgaaacttccaccccaccattcaaagtacaactgaagaataaacgatctaacagattcttgtgagacacattatcagataaattaatccagtgacacatgaataaagatttagagtttttaaagaaatacagtaaaagcaaaaacatatga

SEQ ID NO: 199 - DNA, 367 bp, Homo sapiens
  Genbank Accession No. AA280929
cccttttaaacattttattttgaaacaattgcagatgtacacaaaagttgtaaaaataggccacagtgctcccattttgtccttatatcagatttcccatttgtgagtgattctgaacaataagttgcagacatcttgacccactactccttactattccagtgtctatttcctatatacaaagggaatctaccaggtaatcatagtacaacaatcaaaacctggatgttaatactgatccaatatgaatataggatcctcaggtgccattcaacattttgcctcttctcctttatattttaaaattatatatgactacttacatttttctagaagaaaaaatagaacaataaatcacaaaaatgcc

SEQ ID NO: 200 - DNA, 427 bp, Homo sapiens
  Genbank Accession No. AA281145
aacagtgagatccacctttattgaaacatcacacggcagcatcagggctcccacacctcacagggcagcaggcagttcacaggacagcaggcagttcacagggctttgggggcctcacagggcagcaggtggttcacagggcttcggggggcctcacagggcttcggggggcctcacagggctgcagggggttcacagagcttcaggggcctcacagagcttcaggggcctcacaggactgcaggggggctcacagggccctgtatgcagggctgctggtacaaagaagaggcccagagaaccctaacacagcctggggccccggggaagtcagggcttccagcagggcaggtacagaggcccctaggacttggcaggagctcagccttggggacagtcccacggaagacgctgcatccgggctctt

SEQ ID NO: 201 - DNA, 257 bp, Homo sapiens
  Genbank Accession No. AA281345
ttactcttatggtttttattttcctatctgacatttctaacattagccatgtagacggagttaaaaagaatccaccgcacgaaaggtaaacaaagcagaccctcagaaactccctggcaaggaagaacccctccccagattggcccagtttcaccagcaactggtctcagctcagccttatgcctttccactgacaccccccacccctccacattctcgatgattcagaccaggaacttctcggctgattgtgtccg

SEQ ID NO: 202 - DNA, 365 bp, Homo sapiens
  Genbank Accession No. AA281591
tttttttaattattccttcatattcaaacttcacaaacagtgtgaacttgtacaatacctcggaaagtgaaacttacaaaaaaagtgctggtaacatttaaaaaaaaaacaacaaaaaccccaaaaaaacaaacatcattcttagcaacatcaattactcttccacacaaaacagaaaccttgtaaaatttattttcgtatttttaaggcgtaatacttccgtataaagtatatgcaagagataaaacttcacagtattccaaaatgtcacaataataataataatataatagtataatgaagcgctacagttaatttttctttttttgaatgttttttttcctgtttaaataacaaatacaagt

SEQ ID NO: 203 - DNA, 369 bp, Homo sapiens
  Genbank Accession No. AA281599
gaaaaggcatacaaatttattaaggtacagggctgaggaccacagaatattaccccaaccccccagtggttacagaagcttatatactctttctcagaggcaaaagaggagatgggtaatgtagacaattctttgaggaacagtaaatgattattagagagaaggaatggaccaaggagacagaaattaacttgtaaatgattctctttggaatctgaatgagatcaagaggccagctttagcttgtggaaaagtccatctaggtatggttgcattctcgtcttcttttctgcagtagataatgaggtaaccgaaggcaattgtgcttcttttgataagaagctttcttggtcatatcaggaaattcca

SEQ ID NO: 204 - DNA, 375 bp, Homo sapiens
  Genbank Accession No. AA282247
tttttttttttttttttacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaagg

SEQ ID NO: 205 - DNA, 267 bp, Homo sapiens
  Genbank Accession No. AA282739
ttttttttttaaatttttaaatttagaaatttattctgtttaatccacaagctttatatagctttagtttaaaaaaaatcaaaacaaaaaaaaaaatcaaaacaaaaacagtgaaaccaagacactattccaaagtctgggcccttccagccttccaaatacaagaggctctgaaagttgtatataccaattggacgcacaagacaaaaatatgaacagagccatgacatttcattaaacaaattgtatgtaactgaaggatccttt

SEQ ID NO: 206 - DNA, 348 bp, Homo sapiens
  Genbank Accession No. AA283091
acatttctttaaataatatttaatcaatgaatcacaaatatttaacctgtcattatgtcaccccgctggacaataatggagagagtggggtatcactgctgtcttataacttttaaccccacaaactttatttgcatccccattaaaggacaaggccatgctccatttctgatctgttcctgggtcactcagaaactgaggctttcagacagatctgtgcagtgatgagaaggacaactttttgaaatgtggagaaaaaaatatgacatcttttaatgtcaggcttcttatctgagcaaaaaaacatgtatcatcttttctttttgtcagtgtgacagctggatgaca

SEQ ID NO: 207 - DNA, 399 bp, Homo sapiens
  Genbank Accession No. AA283772
agaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgt

SEQ ID NO: 208 - DNA, 426 bp, Homo sapiens
  Genbank Accession No. AA283774
gcggccgctaccgcgtgtaacaggcgatggagaagctgcggcaagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagcagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattccgcatattgcagttcttgtc

SEQ ID NO: 209 - DNA, 265 bp, Homo sapiens
  Genbank Accession No. AA283907
catttttgtcatttattaacctggaagcaaatatgacaaaacagtcatactagtaagtcatctgaattttttaaatctcttaataaaacaaccaaatcccacgcaaatcagtccacaagggaggcccccgcctccactagtgcagggtgactgagtgtacaactacgggccaacccccgcctctcaaccggaagggagggcactcaaaagaggaatttagagaaaaggcggagagggcggacctcgggaaagggtctgggcggga

SEQ ID NO: 210 - DNA, 242 bp, Homo sapiens
  Genbank Accession No. AA284153
tgcacaaaaaagagcagtaaaataaatactcagaactttcccaggttgtcaactattaaaataaaacctcagcatttcaaaaaagcttattccgctgcaggaaagaaggtggacatttttggtaccataataaatcacacactcacacatccatattgcttaggttgaagagaacggaatgaacagaggaaatttcttccatgaattgccctcctttcggtacccgccatgttttagttacc

SEQ ID NO: 211 - DNA, 326 bp, Homo sapiens
  Genbank Accession No. AA284777
ttttttttaccagtaaaatagttttatttgattttaaaatagtcatcaatgtgaaaatttctcaaagcttaagagtaacagtctagagccaaggttgggagtgggggccaggcctcacacagagcccagcttgaggcccctgagccccaccctcctttccagagggagggaggagacagctgagggggccctgaatcagtcctctccctcgtccccaaggccagctgtgccaggcccctggagggcaacagctcatgcggaggactggggggggaagcaaacaggtaggaaacggaaatgaggttaacaattacaccatcaccccc

SEQ ID NO: 212 - DNA, 428 bp, Homo sapiens
  Genbank Accession No. AA284879
ttttttttttgattagtcaaatatttttattttgccaaagaactctaaaagcctttggtgattcccaaacatacaatgaaccccaaataaaacaaaaccaaattgcactattacaaaggaacaagtccatgaaagtagagaggaggcgccagttaagggacagcaacttcaaggagacggttgttttttcgtttacatgttgggacactcccatttttctggtttccctgaataaacttcacacatactttgtccggtctgaacaggtccagggctccaccggaaactccaatattgagcctccggttgggtttggcctaaaatttttgcggaagaacctgggtgggccatttcaaaccaagtggatccctcctgaaaagaaaagttcccttactaactgcttctgagccctcctttaagtggacggc

SEQ ID NO: 213 - DNA, 425 bp, Homo sapiens
  Genbank Accession No. AA284920
ataaagatttcctccaagccacatgaggactctggcacccacccacaaagcaagacctgtatttataagccgagggtcagggagctaactgcgggacccgtcagccccgtgtacccatccccgtccccacccccccctccaccgctgggcccatcagtgtgtgttggggggatgcttgcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaatttttttaaaattatgaatcatatcaagtagttgtttacatttcttgaaaaaataggaactcgggcagca

SEQ ID NO: 214 - DNA, 302 bp, Homo sapiens
  Genbank Accession No. AA286862
cactctacactctattctttattctggcctggggacaagagcaaagagatgggccagtgactcagtctctgtctctagatatgcaagttcctggtacagctcagcatggatttcagctcctactacaaccgggtacacatcctgggggtgagcacacagcaaaacggggtgggacgtgcagagaggtatagggtaaaggcaaaggaagcagaggatgagaccagcaggccctttctctttcaggagcctcgaccacacctctttggtcagatgttcgtccgcctgcagcttctgagagctgt

SEQ ID NO: 215 - DNA, 382 bp, Homo sapiens
  Genbank Accession No. AA287107
gatatacaaaatgattttattagatgccaaatttttattaacaccattttatttcttttgcagctttaatttttaacattataacatttactggctcctctgggtgactaaatatcttcacatgcccactagctaaaaagaatttctaagtagaactcaactgaaactgcaagctactgctctaagaaatgcatacttatgtttatttgctctcctatataatcctgtttacaaatagcataactgcaaagatttatatgtaatttctaaatccttcaggttgctctaccattcatcttcttatgtctggcaagataaacactcttagtgaacactttgctgcatctcttaaatgagatttgtctccagtttatttcctata

SEQ ID NO: 216 - DNA, 405 bp, Homo sapiens
  Genbank Accession No. AA287389
caaaataattaacctttttaattttttaaaggaaaaatactctccataggaaggcatttctattttttgtccatcagtagccaaatggaacttgatataaacacttccagtatgccaactttggtttaatgcacaactttgaaaataactcattaaaacacacatcaagatgctactaacaaattcattaatatccaagattcattactgtatgtcaaaggtcatccaggattaacattttcattacaatgaactgtgaaattccaatgaaaaatgtttgcctgaattaaattatttaatctctcaaattggaagtctagcactcttgaaaatcaaattcacacacacacagacacacacacacacacttacaaactgcacattaggacatgagggcaatttaat

SEQ ID NO: 217 - DNA, 478 bp, Homo sapiens
  Genbank Accession No. AA287832
  unsure (1)..(478): n = a or c or g or t
cacacacaaatcctgatttattccctgtttctcatacatcgttggcattgttctacttaaacagcgacagtgatgactccaaaaaaaatgtttagaattagaagtgcatgttaatctgagtaacttaagtacagaaaagagttagtacaccacaagcattttctacacttttattttgtggtgattgtgagacaaacacagtccaaacaatagacttcttgtcctccccctcccaacaactatctgactccatagctcatgcaccccaattacagcaggtgtcgggctggcataaaggcttcttaccaggattccagtttatccttctcaatccttttctcatctctaacaaaaatgccacacatacatgtagttgtgagaggcaaagtcttctttacactcaccaccagggnggcgtatgggagcacaaaagcctcacaaaactgctccaggatcctgcctcttccagggccggaat

SEQ ID NO: 218 - DNA, 475 bp, Homo sapiens
  Genbank Accession No. AA287870
atcggcagcactgaagctttccattctttattttcatcaggttcaaaatcaatttccaaacagtctcctacatttttcccactgccatggggtcctgggcgtccgggcccccaatattcacgcactcgcaccacgcactcatattccctcaccccaccatcacggccccaaagaaggtcttccctctcgcgaagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtagcgccccccgtggtgacaaagacagtttggctgggggaatcctgggggccagcacccccctccattggccacacctgctgctgccagggcagtggagta

SEQ ID NO: 219 - DNA, 216 bp, Homo sapiens
  Genbank Accession No. AA291676
ttacttacacctttctattttttattttttacatcaaacaggtaatgtgatgatgctgtaacaaggtttgagggaagcatatctgacacatgagcatgaaaccaaatcaccatgcttatggactacaaaaggacctaagccttttaaactagactgtctcaactgtgcattaattatgtatttagatataggatatgtgcttgggaaaatgtataa

SEQ ID NO: 220 - DNA, 346 bp, Homo sapiens
  Genbank Accession No. AA291970
ttgttttttttttgtcttttttttttcttttccatttcgttgaaatatttacagcaatggggaaggaggaggagagaggaaggagtaagagggccccctagggaaagatccaagcccaggacccactccccagggagatccagacccaaaatctgctccccagatagccgagcccacaggactgggaactgcccaaatatggccacccctgtgggctgggggccctgcggggaagttgtgcttcatcaggagtcgccccaagggagggggtcattgggtgcactgggaggcagagggggcaggtttgcttgcggggcagggaccaagagcaaggggaaaggagctt

SEQ ID NO: 221 - DNA, 431 bp, Homo sapiens
  Genbank Accession No. AA292328
atagagacagggtcttactatgttgcccaggctggtattgacctcctggcctcaaacgatcctcctgccttggcctcccaaagtgctgggattacaagcataagccactgcacccggccgagaggggtttggaatgaaggtagaggcagggggatgaaggcgccagagctgaagaccagcccccagaagccacacccctgcccttctagcagctacgggtcctctggctccgggccttgtaaacctcgatgagcaggtccttgacgtactggatctcgcgctccacggactctgcccgttccttcagctcgcgattccgtgcctccagcccctggaactcgaccctccagggcctcaccctctgcccgcttccgctggcggtacctcagagccgccgacttgttctggtctctctacttttgcttgcggtc

SEQ ID NO: 222 - DNA, 328 bp, Homo sapiens
  Genbank Accession No. AA292533
ctcaattaaagatttgatttattcaagtatgtgaaaacattctacaatggaaactcttattagatgctgcatgtactgtgctatggaccacgcacatacagccatgctgtttcagaagacttgaaatgccattgatagtttaaaaactctacacccgatggagaatcgaggaagacaatttaatgtttcatctgaatccagaggtgcatcaaattaaatgacagctccacttggcaaataatagctgttacttgatggtatccaagaagaaatggttggtgatggataaattcagaaatgcttccccaaaggtgggtggtttttaaaa

SEQ ID NO: 223 - DNA, 318 bp, Homo sapiens
  Genbank Accession No. AA293187
atggtacaaaaatagtttattacaaaagaaatccaaccaaaatgcttaataatttacatcgtgatccgtgcccgttacggcccacctctcccctcctcagttatctggtagagagtggaggggagtggctgttccctgggtccaccagctctgggaggggacatggaaatggaagatgtgggtggcattccggacagggactggtgcctgagaatgctggggtcagagtcctgggagggagcgagatgggggaacatctgtgctcagaagagggggtgtatgggtaggtgcatgtgcttctgtgcaaatcctggtccc

SEQ ID NO: 224 - DNA, 424 bp, Homo sapiens
  Genbank Accession No. AA293489
tttttttccgtagtccaaaggctttattgttctgctgaaatgcttacaaatactgaaaacccccagcctgggcccaggcaaccaagggctcaatgctgggaaggagagcaggggaggtgggcttagtgttaaggcgtgaagggcgaggccagacagctggaggcctggtcctccactctccatttccatcacccttcggaggctgaaggaagggcggcggcaccacagggcccttcccctctgctgcatcatctcctgctcaggctttctctctaggcgcattggaggaatcctctttccctgtcggaaactcaacactgtacagaactccaaccataacccttctagcttcctctcccaactgcatcgctcctcctctgttccatagatcccccggcttcatcccttctggctctaagcaagg

SEQ ID NO: 225 - DNA, 551 bp, Homo sapiens
  Genbank Accession No. AA293544
ttgtagagatggagtcgcgctacgtggcccatgctgatctcgaactcctgagatccaatgatcctcccacctcggcctccccttctgcatatagtaggtgctcaataaagaccaaccagatgcaggagtggatgacttcattgctcgggactttgttgcttgggtgaccgtgaccttcaggccccggcaccctaggccaggacgctgtcgatccaggccgcatagctcgccacgcgggtgtagatcccgggcttcttgcggttgccgcaaacgcgcgacgccgaggtgaccacgccctcgagcacgcccccgcacaccagcaggccccgcggagtcacccattgcagctgtcccggcgattgctctccgcgcacatcaagcgctcggtgatggcgccgtcgtggtgcgtgcgccggttgcaggtggcgcggtccagcactggcaagagcacgtgctgcaggctgtccgggctgcggccggttggttgactatgcccaagcggccacgtcgcaatagttcccggttcacgtcgcggtccacgcctgccaggg

SEQ ID NO: 226 - DNA, 340 bp, Homo sapiens
  Genbank Accession No. AA298981
  unsure (1)..(340): n = a or c or g or t
attcggcacgagtttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttncgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcatttgagtattt

SEQ ID NO: 227 - DNA, 535 bp, Homo sapiens
  Genbank Accession No. AA308998
aggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggg

SEQ ID NO: 228 - DNA, 324 bp, Homo sapiens
  Genbank Accession No. AA312946
  unsure (1)..(324): n = a or c or g or t
gaagttaaaggncactttattnactgacagattgaaaactgtaactccaggnagtgcaaaatgcaccacaacccaattacaaagaacaggtgttaacacacaatgtttaaacaatgctacactcatttttggcaaagtgctgtattgttcagtctgtgtacaaaactgaccatctatganccaatcagtataaaaaatttctataaaancaaaatttagncagtggctcaagaaaacaagctgccatttatgcatagnntgatgtacagnaacctaaccaaatgtcccttttgaattttcaagttactgaaaaaaaatgtgtcg

SEQ ID NO: 229 - DNA, 428 bp, Homo sapiens
  Genbank Accession No. AA316686
gggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatc

SEQ ID NO: 230 - DNA, 160 bp, Homo sapiens
  Genbank Accession No. AA328993
  unsure (1)..(160): n = a or c or g or t
gctttagagcagttatgggagttatagattataacatattagtgatttgtgaaacttttttactaaaatgtgaccctcattttnctttacatgaaagaacatagaatatttcacaatgcatcccacgtggtaagaataaaaaattgttttagttatatgt

SEQ ID NO: 231 - DNA, 359 bp, Homo sapiens
  Genbank Accession No. AA342337
  unsure (1)..(359): n = a or c or g or t
agagataaccagtttattttggggagcaaagagaaagggtccctaaccccagactgcctgcgaagaggtgaaatggaattgaatgggattatggtcagccaaggcttcctagtggagctgctacctganctgagttttaagaggggtaggaaagaaaaaatgtagtgggtcataatggcattccagatacaggggacacaaacagctctgtgtttatgaactacaaccagttgttgacttttgtttcaagtggctccccttccccagtgctgtgtggacgatggactgaagaggagaaggctgggagcaagggaccagtaagctgttgcagcagtgcaggtgagatatgaggcctcaac

SEQ ID NO: 232 - DNA, 354 bp, Homo sapiens
  Genbank Accession No. AA342918
accataattgactttttatttaaaaaattacacggagcaatttccagcttatctttttttataaaagtactgcctatatcaaacattttatatcacgttaattccattgaagagctgcctttttctgttaaggtactgattccaattgatgggatacatgcccttaatacagaaagtttccattatttattcaaatatcaaaattaagattattgagaagtttattgctttatggctgggcaagatgctactagcacattttaggtaaataatattctttattaaaaactatgagggtcattctgtttaaaacttttcaagataattcacggggaaacaggtatatctattcaa

SEQ ID NO: 233 - DNA, 346 bp, Homo sapiens
  Genbank Accession No. AA347359
  unsure (1)..(346): n = a or c or g or t
gtgttgcaaagcctttaattagaatgtttgtattttttacatcatgcataacttcacatttgtgattaattagtaattatttcaatacttgtaagcncatctgcctcagatttaatcataatacatgaattaaattaatcaaattaaggaacagcaatttagaaagaaacacactttaagaaatcaaaattctcaattcaggcagtctgtttctatcatttggtattctactcctttaaaaatttcatattgcccaacaaaaagtggttatttttactgtttttggagatgactgaacagatgaagggcatcagatgccttcatcagctgggtattttgcctaaga

SEQ ID NO: 234 - DNA, 347 bp, Homo sapiens
  Genbank Accession No. AA347578
  unsure (1)..(347): n = a or c or g or t
gataatttagaaatttattacaaaacttttaataaaaaatacaatgatattacaaatttggtttnccaaagctttcaaatttttctnaacattatctntcgttttaagancacttttgaagtcggcagtnatttaaaatccttactagaaaaaaaaccaaagcccaaggnttttgcatttagncatcatctaggtatacagcgtgttttccgaaagcatcctttaagagtttggagatttgatgaaattgctcatgtaataagcagttagtgaatactattgaatccnaaacccagataagtcatcttgggctggctgtgtttttcatgtgaaggaaactcatttta

SEQ ID NO: 235 - DNA, 174 bp, Homo sapiens
  Genbank Accession No. AA348446
  unsure (1)..(174): n = a or c or g or t
aaancaccatggcattttaataggtaaatgataaggnagggatggaacaaaagacccacaggtttgctctagatgtaatcattgagatagataccagaactgccaacactggtgtgttgtgttggcaactcaaatagcagcaggaggatttccatagatggtgttttccaaagt

SEQ ID NO: 236 - DNA, 351 bp, Homo sapiens
  Genbank Accession No. AA349417
  unsure (1)..(351): n = a or c or g or t
agtgtacaagagtttatttaatgatatctgantttagttctatcatgtggggcccacgttacaagtnccatctgggtccattacaactctaaccaaccccccaccnccccccaaaaaaaaggaaagaaagaaaatccacaactttttccatgtcattaaatatattcatatataataaccataatatattagtatgcattggaaagggacattgacccaaacaatacgtcatggtcacaactaaacatttacaattctgagtgaacagaaatccaaaacacaggagggggcagagggaggaggggaagtgcatttgggaggagggaatgggnagnaacgtccaatgacagg

SEQ ID NO: 237 - DNA, 196 bp, Homo sapiens
  Genbank Accession No. AA350265
  unsure (1)..(196): n = a or c or g or t
caatagcagacttttaatcaatgccagagacaaagtgaggccgagctaagaacacgctcagctncgttacaatgaagaaatggtttcctttcgatgcaaagtataattgtaaaccacagtgctcgcacagttcacgnctgnttaaagngaaatcttagccatacatcacctaaaagtaattaaaaagtcaacacag

SEQ ID NO: 238 - DNA, 286 bp, Homo sapiens
  Genbank Accession No. AA358038
  unsure (1)..(286): n = a or c or g or t
caggttatttctctttctcctttttaatgtagagctgcagatacacttaagttgccatagtaatggcagaaggagggaagggtgttttctttgtaaaatcattggngtatacaggatggcttggcaggtaacaacactatttctacgatatctacttattaatataattttatgttaatatcccattctcctcaccataatcaccataatgttcaaattttaattttgtattcattttgaatgtttgcatgtgaaaacccaactaatctattatttcaacattaag

SEQ ID NO: 239 - DNA, 463 bp, Homo sapiens
  Genbank Accession No. AA370867
gtgttccaataaaactttatttatggatactgaaatttgagctgcacataatttccatgtgttatgaaacattatactcctttcaattttttaaaacattgaaaaacgtacaaatcattcttagctcatgggccatacaaaaacaggcggcaggctattgacctgagggctagaagtttgctgacccctgctgcagaccttcaaggtagagtcagatctatttcatctatttccctcactggctagtggcagggcctggagaaaataatacaggttttggaggagtgtaagtttgaattcaagttcaagttctatattacattgtactcagcaataacagatactaaataacggttgctttcatgcccttttaaagtcatattttttattgggacctgctcagttttttatcttaattccctcttatcccaataatgcaggttctcaagggggctcactaagg

SEQ ID NO: 240 - DNA, 332 bp, Homo sapiens
  Genbank Accession No. AA371520
gctgagatgagatgatccatcctatttcagagtccagaagactttctgcaagatcagctagggtatttggttaaactaaaaagaaccactaaaaccccaaaaaagcagaaacacccttaaccccctgtctaaactggaatcaaatcaaatgagtgaaggatgtcctttgatttctcctggatccacatttttattcagtggcacaaggtggttatcagggtggtagtgtgtagtggatgatttaccttgcttgttttgtgttaacgattctgtccaatacatgctgatcaagcactaataaaagactagactgaacccagatgtgacattct

SEQ ID NO: 241 - DNA, 287 bp, Homo sapiens
  Genbank Accession No. AA374109
  unsure (1)..(287): n = a or c or g or t
cgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggntcccacgtggttgcagatacctcagacctggtgctctaggctgtgctgagcccactct

SEQ ID NO: 242 - DNA, 265 bp, Homo sapiens
  Genbank Accession No. AA376468
  unsure (1)..(265): n = a or c or g or t
gtaatttaaacaaataccaaaagctttatttaagcaaaaacacattcaaccacagaacattcagaaagctaacaggntcatttctacattcattctgcaaacagtgtagtaagaaaggtaatttgagaatttccaaagatgttctcgctagccattatttatggtaattacataacattttgatgtcaagttattacagacttaaaagttaatatagcataattttacaatcgtactttcactatgatttttattttaaccctgg

SEQ ID NO: 243 - DNA, 292 bp, Homo sapiens
  Genbank Accession No. AA380393
  unsure (1)..(292): n = a or c or g or t
catggagtcagggacatgtttaattcatttgtgaatcccctggtactggcacatagaaagcgtcccatattatctgcaaaatgaatgantgaataaatgagcaagtaggtgaatgantgattctnaggtctcctccagctttgatggcctatgaccgtgtgactcctgcatatgcatgancacacagacacagacactacacacatgcacagacacacatacacacttggngcaaagagggatgaagcctgccacactgcaggtggtcctagctgcctgacctcccttcctt

SEQ ID NO: 244 - DNA, 255 bp, Homo sapiens
  Genbank Accession No. AA382275
  unsure (1)..(246): n = a or c or g or t
aaataataaatgaaagattttattcatctttgtagataacaagcactcaaaggttaatgagtgaaggagataaccatctcctccaaacaaagnggctcttaataacgcagaagcaaaaatctttccacttttagatgaaaacaaactaaaaaataacttcaggcttcagatatggaaataaagcaccatttttcaaatggtagacttggcttacttaaaataagtaaatagcccccgnctatctgaaaaagaaaa

SEQ ID NO: 245 - DNA, 407 bp, Homo sapiens
  Genbank Accession No. AA386264
  unsure (1)..(407): n = a or c or g or t
ttatttaataactgtagaaatccaaaagaattagcatcaaatcttgaagtcgtgagtnaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggctctggagcttggaggaagactaaaggaatgtgtagtgattctgaagtaagatgtagacctacgcagcagagctatgggggagaagattaacaaagtcctttcttccaatatcaggatagtcatgagttgcagtcccatccaaaaggtcattagggctnaaaggccctctgtgtctctgaactatgagattcttgctcc

SEQ ID NO: 246 - DNA, 205 bp, Homo sapiens
  Genbank Accession No. AA386386
  unsure (1)..(205): n = a or c or g or t
ggnggtaaaattncaactttatttggccaatgtgttcaattcgattgtnaaatagaaatgcctganganctgtnagcgtctgattcagctccagcatccttcttcaggccaaagaactcgaggatgcgctggttgtcggtgtggtcgctgtcgatgaagatgaacaggatcttgcccttgaagctctcggctgctgttttgaagt

SEQ ID NO: 247 - DNA, 440 bp, Homo sapiens
  Genbank Accession No. AA397919
ttttctgtttaagaacagctggtttattcttttgatttattgtaggtattaaaagtttcttttgtgagatggcacataggcaggtttggtgtttcctaacactatgaatatcttaaattgcttttgaaagttttatccacaaagaaagaaaaataagggtttcctcacagttgaaaatagtttttgaaaaaaggttaagaggaaaaaaatctaaataccatccttgataaagaaatggaacttcaagttaaaaatacaaatttaaatgaagttttataaaatattaaaaactagctaaaagtacatgcataggcatttaatcaaggtaagaggaacagcagtggaacttaaatatgatacaatttatcaacaataaataaacatttcagtgcaaatagtgcagaaaaatttctcaaagatcatagcaatcattctaatcg

SEQ ID NO: 248 - DNA, 425 bp, Homo sapiens
  Genbank Accession No. AA398280
tttgcgtgggtcattctgatggtggctgctgtcagcctccaagtggcttatgggataggacaaccccccaggcacttcactgtaggacagttagcaccaagagctaaggttgtgagataatgcaaatctggcctgtcacctctgcagagtacaggttcccatactgtgaggcagcagcagcagagggaaccaccagagaaacagcatttcagaattgtctttcctttggtgtatggatatgtgtgtgttctagtctttggtgggcaatggaatctgcagctccatgacaatcttgttaagtagcttatgtgggaagtgtttcaggtcacaagggccacccattctaaggcttctcacttaattccccaggctaagagacaggtggggaaaggaaaaacctagcaccttgctatactgaattggaa

SEQ ID NO: 249 - DNA, 515 bp, Homo sapiens
  Genbank Accession No. AA398719
tttttgcataatgagcgcattttattaaatagatagttaacgcactgcttcttactcattccaagttgctgtaggtgctgcccgcattaacagcagggacaaaagcttcctatgcgcgtttcagcaggaatactctctccactccaggtacttctttgttttggatttttttggcatgatttccttcccatgtaaagaaagccaacttcttcaagacacaggtcattcagctttagtggtggcctccaggttctccttgggccgtgcagaaggccaggtcccgcacagtgaggccctcctttgtcctccactgaaagcttttcactgttcggtctgcaaagaaagaggttcgcctgcccctgctccactcgccagggtggaagtggtggagggctgggaaagggctttcttcacagggcagtgctctcggtatcattgtctatatccagcaggatgcggccaggcacgtctttgctggctgagtctgagtgcatttcaggaaagatgctgcgatg

SEQ ID NO: 250 - DNA, 382 bp, Homo sapiens
  Genbank Accession No. AA398903
tttaaattagtagagacagggaatcttactatgtgacccagactggtcttcaattcctgggctcaagcgatcctctcgcctcagcctcccaaggtggggttatatgcgtgacgcgctgtgcccggctccaaagaacatttcttaagattggtggtgcaaggatcacaccttgagaaacactgatttaggccttcccacagtacaaagaaatgttgcctgccccatccttacagcacacctgatgacttacaagaggtgctgctgaattcctcccagggaagcaaccttaattcttctcagcaagacaaggaggcagccttcaggaaggacccaggagcttggtattagaggatgatccaagtctgatggcaaatttagagtg

SEQ ID NO: 251 - DNA, 449 bp, Homo sapiens
  Genbank Accession No. AA398908
tttccagatttataatttaatggctgtgcagatcccagtccctcatttctgtcgctcacgtgcccactggtctggggtcagggttttctgttcaaaggcatggatgtgcgggactcttctgctaggcacgcgttcaccagcctgtgtctctgaagcagcggtttcccctcgaacttggccgacaccaccaggactcggaagctacaggagcaacggttgagggtcgtgtcctccacctccacatgctccgcctccaggtcccgctgcagcttctcgcggaggtattcggcgctgagttccatggcggcagtccagctggaacggcagcccagcagggacacaaccccagctcgggcgccggcacgctaccttgctgccttacaggagccacttccgctggaaaactcacttccgccttactaaggcgtacgtcaacgcagtacttccgc

SEQ ID NO: 252 - DNA, 384 bp, Homo sapiens
  Genbank Accession No. AA399101
ttttataaacattattaaattttattaacaaaacattttgtacattttaatacatgtggaattttacatctaggtaaaataacaacacattcaaaatttaccatttatacaaactgttacagaataacaaccagtgggttaaataagtaaaataaaccacactgattttttaaattatctacaaaagatttgactttaaaattcccctgaacatataaaaataaattaattttacttttcaattaaatctaccaattagaaatattacaaatcaaaatatcaatgttatcttatgaatttgtcacaatacaaaacagattcacaaaactttatttacagaaatgaggtaagaactgtgcaatgtttaaccaagaaacatattgc

SEQ ID NO: 253 - DNA, 333 bp, Homo sapiens
  Genbank Accession No. AA399273
tttttttttttttcagaactatctgatatttatttcccaatattttgatacttgttttacaactggaatacatggaatgaaggggctgatatgggaccccaggtaagagtgaggtcaggactctctaagggtctggggttccccctagagggactttgggcatccagtttcagggactgagccgggttgggtcggggggcagcatggcatcggacgtggtgccgtctgtgcctctcctgcctgcggtacagccggcgcaggtgtttccgaacggcccacagcaccaggtacacctcccacagcaactcagcctccggagtcttcaaaggtgac

SEQ ID NO: 254 - DNA, 426 bp, Homo sapiens
  Genbank Accession No. AA399542
agtggttctgggtttaattgggggtgaaagggtgccgcacagttgctcagaccccccatggctccgcgccatgagtctccacctttgcgactgaacagaggagcgtcgcctaactagaaacaattcccccctcgagtctccctccagcactgtgtgacggtggcagggagtgggaggttccgccaatggctggcgggcaagggggagcccgccggcctaccgccctgcactgctacgagggcaggcgtgggctcctcacactcactcagtgcggaggatgatgtggatgccggaatacgtgaacacggggccgctcatatccccagttcgcagcggaaacgaggcgtctttaaatgggttctgcatctgacctctgctgaaggcacccaggtcttcccttgggttggctgagctgcagtcgctgaa

SEQ ID NO: 255 - DNA, 481 bp, Homo sapiens
  Genbank Accession No. AA400034
tttatcatcattacatatttattgagcatcttttgtctccaggaaacttacattttaatgagagacatacataaaataactttaaatagtgctatgaagaaagtaaaacatgacaataaaatagacagtaactgggaagttactttacgttagatgatcagagagctttttgcagcggtagaatataaactaagacctggataacaagaaaaagccaatcagaaagatctgaagaaagtatttcaggataagtgaatagttcaaggccttaaggcattaatgtaacatatataatatattactaataaaggagggttatgctgaggcgccctaggacaagcggccatgagaattcacaggcgtaagaacatatgtaaaagtagatacagaaggtttgtgagaaacaaattaaatgagcctcaaatttgagcaggtttcattaaatggacatgtcaaggtcaaggaagagaacccaagatac

SEQ ID NO: 256 - DNA, 486 bp, Homo sapiens
  Genbank Accession No. AA401297
ttttccaagttcacatcttttatttctttttaaggcaaagcacccgcagtcaagccccgccccgtcccccagccccgagtccctgtcccaccccctttccccctcgagccccgtcagctgttccccttggcctcgggttccctggcgtcctcggcagccgggctgggagtcttcatagcatcttctccaagaggtgcgagggtctgggggctccgctcctccttcaaggtcagcccgcccgctgccgtctccttgggtagggggccctcgagactagagtccaacagcgcggcctcggtcagccccgagtcgtcatccatgctgatgaagatgcccggggtctcgcactcaaggcccctcctcccggaaatccatggcttcctcagacgggggcgggcctggccgggcgacggagagggagagggggaggaagaggagggggctccactcctcccggcttcagcttctgttcctcctccagctgcc

SEQ ID NO: 257 - DNA, 467 bp, Homo sapiens
  Genbank Accession No. AA401433
ttttataaactttattacggaaaatgccaaacatacaaaaatagagatgaacatatataatgaaccatcattttagccatcacccagcttcaacaattatcaaggccaatttcgtttcatcaatatttccaatgcacttaacatccagacttattattttgaagcaaattccaagaatcatatcatatcagccacagatgtttgagaatgtagatgaggacccttctttctaacataatgataaaaccattattctaataccaaataccccaccaatgttcaaattaccccgattgtctcataaatgtattcgttttacagttcggtcaaatcacaattcaaataagatccaattaacaattggttaatatgtctcttaagtctctttaaatctataggttcatcctccatctttcatccttgcaagttatttacagaagaaactaggtcatgtgtcctgtagtttc

SEQ ID NO: 258 - DNA, 378 bp, Homo sapiens
  Genbank Accession No. AA401965
gagagcacaactccaaatcatcttttattaatataaaaagggcatatttagcaaaagacacacagataaaagagtcactatggctcaggacacaaggcagggaggtgccaggcctgtgcccctgctgggggagaaggaggctcgggacaaagtgggagaagtgctgggaagggctgagcggtaggggccacaaaagttccggtgggcaacactgtcggcaggtcatgggtgggactcatggggacctcgctgctaactcttgttgtgggggggtgtccttagtgctgccacctggagggccactccttggttcctggaggggacccaccaagggacacaggacaggaagcccaggatggttagtgcaactcgggatga

SEQ ID NO: 259 - DNA, 641 bp, Homo sapiens
  Genbank Accession No. AA402000
ttttttttttgatacaactagcaaatgttcattggtttacaacaaacccaaaatactcatcaaatatgggctgttggatttagaaaaataagattcttgagcgattccagctgcatttgtttatacagaacacatttactcaggaccctgcagtgtcagcttcgttctttgggtatgcagccttctatctggatctctgcaggccagccagaatatctgttgttcttagcatcagagtggttgatcttttctctctgaatttcggaagggagttccaagccttttgctgcaataaatacccagctagacctgaatttcatgttcctgatttctttacttccaagtgcttctatggcattcttggcatcgttattcagtcttgtgcttccgtcgtcataggtcaccatgaagagcagggattttggagcagcactctgaataaactttgtcatcggtccagagttatcgccttcatacatatcaaaacatcgtgttgctgtcacattcccagttacatagttgacaatggcaatgtttattcctctggcaacatttcccagctgttctcccataagtaggttatcctcaaagcagattttggcgtacttgcttctgccacctccgctgagtaacctgtaggc

SEQ ID NO: 260 - DNA, 290 bp, Homo sapiens
  Genbank Accession No. AA402224
tttgtttctaaaaagtttattgtaaaattcaaagcttcaacagcagcatcctttagaaaacgaagcattgcccggatccgttttgaaaaagcagcgcagtcggctaagtccttcacgctcctgcaactgtaccaagtccagggcgccgctccttcctgccgagcgcaggctgctgagtcacgcctgcccggccagtctgtccttcctggccctgaggccaacgtcctagcctaggccttcctgggcgagcagccgctccagacacttgcagagtcctcagctcggaccag

SEQ ID NO: 261 - DNA, 483 bp, Homo sapiens
  Genbank Accession No. AA402468
tttcatggtaaggagtttggattttattcagataatgatcagaagcctcagagggttttgagcaaaggtctgacaggacccgacatccgttttaaggtattttctctggctcctgtgtggacaatagattgtcacctcttccagcgggagaggtggagatgatgggcatagtctggggtgatagtggtagatttgctcttgttcctagtgtaatccttgaaattagtggtgaaactggctgtggatggctcttgcgttggaaggctttctccaggttgtaatctggtcatgagcagcctttctgacagactagagcaggctggatcactggctcccatgggcatttgccagcctgtggggagggtagtcatgcgctgctgttgtactactgttggtgtttaagtgcaccagtggaggcgctaacttgccggagggttcaagatggtctcggggttgtggggggcatgatcagataggacgtgg

SEQ ID NO: 262 - DNA, 465 bp, Homo sapiens
  Genbank Accession No. AA402473
gcggcacgcggtcacaccggcagatggatcagcagcggcaaggcggggctgtgccaggtgcagtggggagaggcaggcagagcagtgggaagtcagtctcatgggcccgggcagtagcaaagcagcaggcagtcagtcttggtgaggacgggcatagcagacaacgaatggtcagattccaggaagacccgcagcagcagcagcagcagcagcaggatggaagatggtcagactcagggaggactggccatggtagttaacagctcttcagactcagtgaggccagaagcagcaggagacggaaggcagttggccttgggaaggacaagccatcaggttttgggggcactgacaggcgtgaggttcaaggcagtcagattcaaggaggtggcagcagtggggaggaaggtcagactcaggaaggaccggcgcacgagtgagacaaggcaacgggaaaccaggagc

SEQ ID NO: 263 - DNA, 269 bp, Homo sapiens
  Genbank Accession No. AA402903
cccagggcagtggtgggtgctttatttccatgctgggtgcctgggaagtatgtagacggggtacgtgccaagcatcctcgtgcaaccggagagcccggggaggggctctgcggccgtcgcactcatttacccggggacaggagaggctcttctcgtgtagtggttgtgcagaccttatgcatcacgggcatgagaagacgttcccctgctgccacctgctcttgtccacggtgagcttgctatagaggaagaaggagccgtcggagtcc

SEQ ID NO: 264 - DNA, 359 bp, Homo sapiens
  Genbank Accession No. AA402930
gatttgcatgttggctcaactctttttaagtccaaggaggcagtccacattaagtgtgcaggcaaaaaagagatggaaaaaggagtcagtttctcccctgccctccctctctccctttatcaagctgagcaccttgagttgcatttgaggaaatgaaaactataggtgacgcaaccccattgtgtcgaattctttctttacattttttgggttgctacaaggaatcagtattttttttttttaatcagatggtgtgtgtggtggctcacatctgtaatcccagcattttgggaggccgaggcaggaggatcacttgaggccagaagtttgaggctgcagtgagttatgatcatgccact

SEQ ID NO: 265 - DNA, 394 bp, Homo sapiens
  Genbank Accession No. AA403159
tttttcattgtgcaatacacttttattttccttttacctttgcagtcatcttcgagtaatcgttgtgtaaacaatagaatggaatgaaattacattaaattgtatgcaaatggctctagaacaccttaacaattatgacaaggcaattataaataactttttttccttagtaatatatatttgctttttgaagtacattaaagagctgccatatctagggttagctaggaaagagcaatggtaccatcctgggagcccacctccttgaaagattagactccaattttcaaaatcctaaggtttactagttccataatatacagtcaagcagagggctacttgggttgaaagtattgattcttgaaccttaacagcgttttaccttttagtcatt

SEQ ID NO: 266 - DNA, 376 bp, Homo sapiens
  Genbank Accession No. AA404957
tttaatgaaaatagaagttttctttctgtcctcctttctctcctccttccttctcctttccggatctttccccaaataattttctaataattcagttgttttctgaatattgcttttaagttttttgattttaaagatacaattagaaataatgtatatgatgaaaaagctgtttcccactccaattcagatctgtgatctacactgggaaaaatgaccactcctcatgaagttttgttactgacctctcttggactttagctctccatctctgctgaggggatatgaaggtatttgcatttctcctgttaatgaagggatcttagaacagaaaataaataaatgcagttttagcgacacatagctggaaatattt

SEQ ID NO: 267 - DNA, 294 bp, Homo sapiens
  Genbank Accession No. AA405331
ttttttttttttttttttttcttttatttatgtatttataaaaagatttacaccaatcaagcctgtaacatgtacaaagtaaatctttttgcaaagttaaatatatgaaaatccaaaagcagactgaattataaaaaaaaaactttttatttttgtcactaaatacaattagtttccctgattataacccataatcaatgtcacctaacatacagatggtctgtacagaggtgagacaaccccaccatctttctctacatatatattaggaccactaaactcagataaagcaga

SEQ ID NO: 268 - DNA, 207 bp, Homo sapiens
  Genbank Accession No. AA405488
tttttttttttttttgacggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaaccc

SEQ ID NO: 269 - DNA, 397 bp, Homo sapiens
  Genbank Accession No. AA405533
ttttttttttttcaagaaaaaaaatcactttaattgaggaacactttcagtttgtgacaaaattatgctgtgaatcaggtgttgcaaattatggcccactgcctgcttttgtgtaagttttattggaacacagctacattcagtccatggctgcttttagaatacaacagtagactttaacatttggaacagggaccagaaaccagagccatacagctaataaacttgaaaatatttacaagttgatgctttacaaaatccatctgctgacccctgctctgtaccattgttctcttctgatggtctgtttactaaaaaataaaaacttcacaaacatgtaaaaaatagatttgccatttaaaatgtgcttttcaagtttgactttttaggatgcaat

SEQ ID NO: 270 - DNA, 348 bp, Homo sapiens
  Genbank Accession No. AA405559
tttttttttaaaatattctgatggttttattaacaagtatataatatatattgcatactgtatatagtatatgaggactgtacagtacaaatttatgttcacagtttgacatgacaaaatgtcattactgaattcccattggactacagagtagaaacagagaaggtacattaaacattcacatctttagtaagaaagattaccaaaatgtttcagtatctgcaagtatactaacgcatgctaaaaacctttacccattcagtcttattagcttataaaatatattacactttattaaaaatttctgcatagtttatacaagtattaaagtactgtaaatgtaataat

SEQ ID NO: 271 - DNA, 359 bp, Homo sapiens
  Genbank Accession No. AA405616
tttttgtgttttttgtgagttcaagtggtttatttggaggcaatcccaggaaacattagtaggagagcagcaggaagacagagcaaggaggaaaggcaatcttttgtgtattaataggcagcttatcacatgagcagctagagctccatccaactggggacctttggaagagagtgtagaacacatcttattcagagttgtctcacttgcggggtgaaggttgaagactgctccttggacaatgccttctccatttcctcatacttttcacctgcctgtgattgggccaagcctggttcccattgcccaagaaagctctcaggaagatgctcaagtgcttgcagtaagaagcaatcagc

SEQ ID NO: 272 - DNA, 310 bp, Homo sapiens
  Genbank Accession No. AA405902
tttttattgtaataaactgtttattcaacattttaccaactagtatactttaacagaaaagccctggaggtttattagactatttctgaagaaaaagaaaattaagacatctcagatacagcagcaacaacaactaacatttgtgtagcactttacaattcacaaagtgctttcaacatacattagctcattgaatcctcacaacaaccctgtgaggtaggtatttttgccaatttacaagtgaggtaactgaggctcaaaggttccaggacctttaaagagatccacagcaaatgattggtaaagatgg

SEQ ID NO: 273 - DNA, 346 bp, Homo sapiens
  Genbank Accession No. AA406371
tttttctcagtcattacttttcttcggtggcactttgttttcttgtgacagtgaaaagggtactgtggagacgagacagccccattgcaatttatcaatgaaaatctaataccgcccataagcagagaagtggaaatcaatacttcattaccaaattgttagtgaggatgaagagaaatggctggggtgattttttttttttttttttttggcagtcttctcagagccagggtgtcaggaggagttcaatgagttcaatgtcagaagcaggatggtgcaacgaagaagggttcagtgtgaggggatccaggctggaaagtggaaactaaggcattcgtcctgcaga

SEQ ID NO: 274 - DNA, 143 bp, Homo sapiens
  Genbank Accession No. AA410298
gcaggctagaaaataattttaatgcaaagtagaaagtatcaatccacctcatcactttccttgctctctctctgtcacctcctctttcctgtggctctgaggaggtgggagaagcaggcagtatttccacagcagctgtccat

SEQ ID NO: 275 - DNA, 298 bp, Homo sapiens
  Genbank Accession No. AA410311
ttttttttaaagtaacatttaatgaatacacatttataaaagccatcatcccttaacatggggaaagtgtacaaaaataatgtgaaagtgtaaaaatttttctagaatacaggaaacatatcagcagtaaagaagtttagtttaactttttttttaaatgtaaaatagtttggatctgttaaaaggaatacagttcgcccaaagcacttattttcatctgttgtaaactcattctttctaccttaagtaaactggaggagtcagctgtgttaatatggtcaaattaatttcatagttt

SEQ ID NO: 276 - DNA, 445 bp, Homo sapiens
  Genbank Accession No. AA410355
gcagcggattgggggtggccaggggatgctgctgatgtgcagagacatccctttttccggcacatgaattgggacgaccttctggcctggcgtgtggaccccctttcaggccctgtctgcagtccgaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcacggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgac

SEQ ID NO: 277 - DNA, 415 bp, Homo sapiens
  Genbank Accession No. AA410383
aagtaaaatgtttgctcaactttattgaatgtcattagatttataggaatcattaaagaattagataccagagtccccccggcccagacccccacaaaaaaagtcagtgaaaaagatgtgagtgaaagaagtttgtcaaggcaaatgtgtgaaaggatacatgtgtacatcaccctttaaatgctttccctgagtattctatgaagtctggggatcttcgaatgctattaatcttagacagtaaattttataaagaaattctttaaaagtaggacttaattctcctccgtagtgagtttttaagcagaggatatctactacatggattcctttgcctcttgacaggctcaagttccatctgcctcccaggcagctttttgagtctttcatagaagcctgcttttaatatatgcca

SEQ ID NO: 278 - DNA, 574 bp, Homo sapiens
  Genbank Accession No. AA410925
taaagttacaacttttctatttctataaattcgaaacattttggcccaattcaactataaacgttaaaccacataatgttttcagtagatgacttcatagactgtagccttcttgtcccccgagccagtgactatgtacttatcatccacagagatgtcacagctaagcactgacgaggactctttggactggaatatgctggctccatagggggtccgccaagcattgaggaggttatcttttccagtactcacaaaccatttaccacagtaagcaaatttcagggacagcacgcagctctcatgcaggtgcagctggtacttgtcaggcttgttcacgtgcagcacctccacattgctgctctccatgcccactgccagccactccccggtggccagtacccaaggagaagatctgggaggtgaagtcgtgctgctgcagctgccgcccctcgcgcaggtcccaggacctgactgtgttgtccaaccacccgtccagagcttggtgccatcattagaaatgtcaatacagctgggctcgtctgtgtggcctggattgctcactagtgctggt

SEQ ID NO: 279 - DNA, 395 bp, Homo sapiens
  Genbank Accession No. AA410954
tttttttttttttaagtgaacatttatttatttttaaatttctctctaggcaaacaatggaatgtattggtggtttgctggtgaaccgtttatagagaattcaactccatccatggctggaagagggtctgctgccttccgcagaggtggtctggttctccccacaaatgccccgacagctgaagtgatgctgagatgcacttcttcaggcaggaggatttgctccatgtagcttttcctgaaagactgaacttctgggggttccttacagctctggcctcggagcctgtgcacatccttggcagctgccctcatcatcttgtctgtctgaagctcacccttgtgctccgctcggtccatccgcttctccagcatcctcagcagcaggcggaaac

SEQ ID NO: 280 - DNA, 406 bp, Homo sapiens
  Genbank Accession No. AA411860
tttttttttttttttagattctcacaacctcttgttccgcagttcattaatccgactctgatgctaaggtgacagtgtatgtaagtagatttttgttttcagtgaaggagacctgggaaaagatggatttctctctgtatcttcaagagttatcagatggtacatgctcctcaaagccctcactctctcgaactagagcacgttccaggatcacgcggccttccttatatcgctggctgtcttcagtggcaaactcatagatccatcccagtttgctattgcagtttttgcagctcacatctcgaaccatgtggcggccagtgagcatgacccgatcttgaacttcactgtactgcaggttaactaccttgttaaaaagaaatgctctgccagtggggcctgtgaa

SEQ ID NO: 281 - DNA, 346 bp, Homo sapiens
  Genbank Accession No. AA411897
tttaagagtctcattttttttattggctttggtctaaaataagcacagccaaataacaagcagctggaaacagttcttacatattttaagaggaggccagataagatttcttcaatagtttaggaaaacatcctgactaaacatatttggattttccttttttcctcgccctgtggtgtatagccctgtgcagaatcaagcagagccctttcttttcacctccttatccaaaacccagggtttattattcgttgacaaaatcatcaaggaactacatagacacacaccatttttgggagggaaggtatcaggtatgtaaaggaaatattaaaggggaataggaatg

SEQ ID NO: 282 - DNA, 73 bp, Homo sapiens
  Genbank Accession No. AA411952
tttcatttaattgattttattataactggattaggtctgagccctgggaaacagacatcaccttgttatacag

SEQ ID NO: 283 - DNA, 289 bp, Homo sapiens
  Genbank Accession No. AA411981
acactgtttattgagtggcaggcacaggagaggtagctggctccggtgtggaagcagaggtggcaggtcatgccagggtgctgtgggcatctggcagccagggccatgcccccatcctagggggacggcacaagctcactatgacaggagcagcaaggagccggccagaggagggggtagccacgacccccaggatcctgggcaagaagcggcagacaaacttggcacaggggcctagggtgagggggactggggcctgggtattctgtgggggagggagggggatcac

SEQ ID NO: 284 - DNA, 406 bp, Homo sapiens
  Genbank Accession No. AA412049
ttttaggaaaaaacggcacagtgatttaatggtaagtcactataaacatgaagggaaagactgccatccaaggaagcgcagaaaaggacacccctcaggtcctggatggaggaggatgacccccaatactggatggagaaggatgcccccagtcctagatggagaaggatgcccccctcagtcctggatggagacgtcatgagtaactgtcggtaggaaacatcatgttcttcattctgcccttgctccttgggctccaacaggaaaaaccagaaattctgtggatataaaacatggaaacattcattctttaaagaaaaaggctgcagagacaagaacagcgaaaggatggtattgaatacatgcaaatggataaaatatgaatgattatgttctcatgttcaac

SEQ ID NO: 285 - DNA, 521 bp, Homo sapiens
  Genbank Accession No. AA412063
ttttgcaaagttaacatttttattgaactgaaattggtgtagaacaggggcaaccacagctgctgagctctgtaacaactgaaaagcccctgtgacattttacctttgagagtcctaacacggtttgagtggaacagctgagaaacagcatatatatattttaacacctcaaaatagtttgaaatgagcctcacagccttgttcaatcttcagattacaaataacattgatagcatctcctgtggccttcagttagtagtgccagttaatattgtttctgaaaactttcctctcaaagtgctggctataattttttttccatccagtacacataagaaaaggatttagtaacacttgggcaagtaataaactgtagaactttaaaagtagtaaaggcatataccaagcatacgtgactccacacattgtcagaaaggcagtggactggctaacgagtttctgccaagtttcagaagcaaagaatgcactaatgaaaagggtaaggcatccaagcagagtgt

SEQ ID NO: 286 - DNA, 336 bp, Homo sapiens
  Genbank Accession No. AA412267
ttttttttttttttgtgtgtaatctttttattaataagcaaaagattgttcagtacataatttaaattccagcattgaaagcagcctcaagagatcacacaattcagatctccttctgtgctttccaaagataggtcccctggattccacatgattgaagtaattgcttatttctgtgattttagaccactggtttgacaaaaacaaaatgaaccacgaggggggagaaagaaaccagaaaccctatttgtaacaaagtctcaacaatgagatacaatggtattagatacacgccaaaacacacacacacacacacacacacacactcaacaaaat

SEQ ID NO: 287 - DNA, 377 bp, Homo sapiens
  Genbank Accession No. AA412443
  unsure (1)..(377): n = a or c or g or t
acttttttgcacacaggagagctttatttctcataagagattgcagccagcagggagcccttctgacaggctaggaagcgtagcttcaggccagaagctganancagacacttggaggggagggacagaggggacaggaatttacgctgaaggagatggccaaatagagatgttcaataagcttcaggaggagtcatgaatattcatgaaaggagaagcgtgtactggtccagctgagcaaattctccatggactgctccgaaccaatctctgatctcttctcgggccagaaggaggggcctgacctctaccccgtcatggctgaggactccggttcagggtttctttgggatccccttggccagaagaaggtccat

SEQ ID NO: 288 - DNA, 387 bp, Homo sapiens
  Genbank Accession No. AA412505
ttttttttttttgaataatataacagttttattataaatcaaaacaccaaacttttgcaaactttacataaacgtgtagccatatgactgtataacaagagcccaagagcaaccattgtctaacaggtagaaatgcagacagtttcatgttaagcctttagaatttcctttcacggcaggtttccaaaataaactaacttttctaacatttattctcacaaaaatatatttcaagttagaataaacaactcattggcttcagacatttaattgtatgtatttaaccatactcagataattgtcatatttagccaaatggaggctttttctgtgacctatttccaaattctcagattctggttcatctactccttcaagcagtttgga

SEQ ID NO: 289 - DNA, 399 bp, Homo sapiens
  Genbank Accession No. AA412722
ttttttttttttttttttttttttttttttttttttccggcacgaggctttttattctaacagcactggggggcccagcctacctgccagacagttcccaggagtgaggctggtctttcctggcagataagacacagttttgttgggtgaatgagcggctcctcccttggtccaggaagagctccccctgcattgggtgatgaaattctgtctttctgaaggccgggcagtgcacagcggcccttcctctctgggaatgcccaggctcacacagtccacttcagacacctggtctcctggtgggtccccagacagcgcacagtgcagtaccgggcaccgcagctgacacaggtgtagggggatgggaagccacagacagcacagaaggggcgctggggc

SEQ ID NO: 290 - DNA, 427 bp, Homo sapiens
  Genbank Accession No. AA416685
tttttttttttttttttgctataagataatttattacagactagcctataatctcctgtaacaatggcacatataataattaacaacagcaaagatgcttggtttcttgtttcatgtaatggccagtacatctgtggacaatgtcgagtcctcaggaagtccaggaggctgctacagaggaaatccaagaaccatgtcacatctctcaacaagtcttgggaagtccatctgactctctgaaacagtttgtctctgacctcccaggaagtgtggagggccccttccatccagcctgtacagagggatcagagtccaggctccttctatagggttgaatatcagaggggaatagcaaatgaccccgatgagagagagagagaccaaaggctagattctttctgcaaggtggaggacggctagaaggcag

SEQ ID NO: 291 - DNA, 527 bp, Homo sapiens
  Genbank Accession No. AA416762
  unsure (1)..(527): n = a or c or g or t
tttttcctgtttctgtttttagtttttattaaataaaagcagaggaagaggaaggcccctggtctcccgggctaggggggagagccatgggtcctcccctccctctgttcaaggtgcactgcgtgctgggcttgaggtgtaagctggggagggagggcagccgggaagggtcagtggtcgggacctgcaaccctttcaccccttctggaagactcgctgggcagggagggagcctcctggacctggactggggcttatcccaagggatgagagccgataggtctacaggctcggcccaagggcccttccaccctaggaagaggaaggggtgccggcgtctatctgctggagggtggtcaggcaaggctgtggggctgggtggccagcccttcactcgtggacgtcccagatctccgacagcagaggcggcagcttcttgtcctggagccgcaagganngacctgctccgagtgcacagagctcagcgtgcgcaggctcaccagcttcatgagcatgcgcgggaagag

SEQ ID NO: 292 - DNA, 348 bp, Homo sapiens
  Genbank Accession No. AA417011
aatttgggctaaacaacagaaatttatttgtacagctctgaaggctgggaaaaatctggtttctttgaatttagccagctatctacttaatgaagcaataaagcacagtggctaaagctctggaaccaaattacctaggtttaaatcctggtctcaccactccctaattgcatgacgttgggccagtttcttggcctctctgcatctcggtttcctcatttataaaatgggcatgtgtgtaataataatggcatctatcccatgagatgatgtatattcaaggtttaacataaaggctgggtgcagtggctcatgtctgcaattccagcaccctgggatcacaggcgt

SEQ ID NO: 293 - DNA, 363 bp, Homo sapiens
  Genbank Accession No. AA417348
tttcatatcctccattttattttttgattaagttcacttattttgtgggggtaagaatttctttcgtttggatcttcagggtattggccctgtgaatgtgtgcccatttctccactatttgccagtcccactgagccaatcttctaccaagactgaaaatagaccatagttctcatttcttgaacagatatcatcaggagagccgagggggagaccattaggcagccccacattttccaactcaacaggtggaggacatgggatttttaccttctttggggattgaacccccacacaccaccaactcccttagcctttcaggataagtatttccaatccctcagagattttcttaggagagac

SEQ ID NO: 294 - DNA, 396 bp, Homo sapiens
  Genbank Accession No. AA417915
gctgaaaaggcatgattttattgcacactcacaatatgacaggtgctgtgctactcatcaacactcttttcaaaacaggatttggagacaggattcttcaaaagagaactgcacattcaactaaacatgtccaaaaaacttcaactcttttgaattagtctccaaatctacacaaaccatagaaaatagaagatcattaaaatacatgattatacacagacaaatggacaaatgaaacagtaattaatattgcttgagctcagattgctcctgtaagatctgcagaaatcgtatgatggggtaaggttttctagaacaatatttcatcaggagataatggcagtatctcattagactaaaaggagatgatagatgctggaagatcagttttcatac

SEQ ID NO: 295 - DNA, 409 bp, Homo sapiens
  Genbank Accession No. AA418557
tttattacaagttactaagctccaaggcacattacagtgttctgttaactacagaaatgtatagaaggacaaacggagcagaggctccatgtctagcatttcgctctactgttcaaaagcatccgggcagcaataaagcgggaacaaaacgggacgtgtagatccaacacattcaggtcagtagaaacaaaccagaacattttcccctcagaaacttgcaacaaaatacaccccatcccccccgacgcccccttaccattttgcaaacaaaacagaaaaacagaacaaaacagaacaaaataaagtgaagacttcaacacttggggcagtttagaaggaagctttcaccattttatagcattttttttttttgttttgtttttttttttaggcagcaacactggccttg

SEQ ID NO: 296 - DNA, 368 bp, Homo sapiens
  Genbank Accession No. AA419011
tttttttttttttttttcaaggggattttaatgaaattttattaaggagatgagaagcagggagtctgtgttgaaaattcaataaagggcttgttttccatctcagcctggataatctatgttatctctgagtaaagggggtaacaattctaacaacctggcttccttagaagtttccattctcatatagtcaccgaaggcagcagcactcaggcgtttgctgccgtgcctgccctttggtttctgggacggctcgggtcccgtagcgccggcacagctgagattgccaagccgggaagagaccttgctccaggtgtagctgcgttttccccagatcacctgtccttttcccctccgacaaggaagct

SEQ ID NO: 297 - DNA, 260 bp, Homo sapiens
  Genbank Accession No. AA419546
cacattaaattatttattgaacaaattgaagataatgacatatgtttttattacaaagtcttccatcatcttatatcattgacacatattatgagacctgcatttgaagagtgaatagaaataagaaaatgttttcccaaccccacaaaaacagaaaaaaatatattaattttataattatcttataaagccaaaagttttatgaattatactttttttattagttaaaaatgacagcataactaaggttaatttttatt

SEQ ID NO: 298 - DNA, 471 bp, Homo sapiens
  Genbank Accession No. AA421131
ttttttctattatttggaacatttattagaataacagtaagcctgtcaagattttttaagccttttagaggttcaggaacattctaatatatattattagattgaatcctcacagcaaccaggaagcaggaactgatcatatttcgcattggaaatagtcttttgctgcctttctttgtcctctctcctgttgttagtggtcaatgtgtgacttccagaaagacattggaaagggaacaccatgggaaaaacctcagatggaaatgcagaaatcacccatcttctgcgtcgctcacgctgggagctgtagaccggagctgttcctattcggccatcttggctccacattcctaattatcaggaagtgtcattatcagcaccgcagtgttgagaggtgacagcgtgctggcagtcctcacagccctcactcgctctcggcgcctcctctgcctgggctcccactttggcggc

SEQ ID NO: 299 - DNA, 523 bp, Homo sapiens
  Genbank Accession No. AA421133
tttttttttttttttttcatttcccttgacattttaataatcactaccttagaaacagcaaagacagactcgggtactcagggaacttctgttctgtcatctgtgaaggcatcaaccttgtgactcagattcttgagcagagatcacgcaacattctacatgagacactggcacgagcaccaagagatcctggaacattgagtttggagaaggaacaaagagacttttccgaaccaccgaaccaaaggactcatctagggtgagctcaatgaatctaaaatcgggaacacacattgcagcccctgtttgggaaatcagcttaagagcaatctcaagtctccacaagaggcggaggtccatattccaaaataatgtgagccttcagttatttgtaggtagaattcaatggaagaaggggtgttatagatacgaaaaatcgtggctggcgttaccaacattaaatgactcgtggtgatggggtaagttgacaagtgaaatccagtctcttcctaaacaaacgtat

SEQ ID NO: 300 - DNA, 412 bp, Homo sapiens
  Genbank Accession No. AA421562
tttttttttttggagaaaacagaacacccccaaaacatttattttttttttagaaaatcatggctcactatggtagtatacaatattgttttcacacatgtacacttgaaaccaaatttctaaaacttgtttttcttaaaaaatagttgttgtaacattaaaccataacctaatcagtgtgttcactatgcttccacactagccagtcttctcacacttcttctggtttcaagtctcaaggcctgacagacagaagggcttggagattttttttctttacaattcagtcttcagcaacttgagagctttcttcatgttgtcaagcaacagagctgtatctgcaggttcgtaagcatagagacgatttgaatatcttccagtgatatcggctctaactgtcagagatgggtca

SEQ ID NO: 301 - DNA, 222 bp, Homo sapiens
  Genbank Accession No. AA424037
ttttttttttttttttggtagcagggttttaaactttattttgcgctccgtgacccttcagatagtgatttgaatgattaagtgaaactcttcttaggttaagtgtcctagtccacgctaaaatcatcttgttggtctctttggcgctgtcagcgaccagtatcagcgcccggcttgtccccgctgcccgccgcgtccctggcccggatgtgggaggcgaag

SEQ ID NO: 302 - DNA, 451 bp, Homo sapiens
  Genbank Accession No. AA424245
ttttctgttttgctggaacttttaataaggaatctcaggttagactttccaagtctctcaagaatacaaagagaacttgtctggcttgtttcaactttgcctgcaatatctgtagactttgatgaattattcttttcttgatgtccccaatatacctgaggtctgccaggaagtgacctttcttactcatctgttgccagattctgtcacttttccagggatcccaattgtagagcaggcagggtgtcccagagatcccatctgggtcaccgaaactgtaggggcagaataataattttctccatatcctttctgtgtttccggctgggacttcctcctttgtccactaatgtaatcccataaaacggagaaactcagcagtgaggacattctgattccaagcaggaaggagatgaacgatgaacctcaggctgagcgcctcacggtttcc

SEQ ID NO: 303 - DNA, 301 bp, Homo sapiens
  Genbank Accession No. AA424515
ttttttttcgattttatatattttattgaaaatatgcacaaaataaatacattttcttttcttttaatccaagataaacaatgtcacatgattaaaggtaagcattgaaattctttcagataacctggagggaaatgtcctttttctctttgccgagtttctctctgggaaatgaagaaacaagattgtgagagttcagagttccttcctcacctgctgcaagttcacactcagcaggtcgccagatgtattacatttaccttatggatggcagagattgtctgtgatcaacagcatttgt

SEQ ID NO: 304 - DNA, 329 bp, Homo sapiens
  Genbank Accession No. AA424530
ttttttttttttttttgctgatcaaattcatttaatctttgttaaaagcatcacaaatgattcatcgatttttaaaaaggaaaaataagaaggaatgcattgtctctttgttatgtgcatggcagctgatggcctcgttcccaggcgcccaggtctacctgaacatcagatatgcagaccctcgaatttacaaccagggacagccacgggcccacgcctggatctccatgggtgcacagacgggaacgtatcaggctgtctcagatgccacctccttcccaggtgcttgggtccacatgcccaacatgttcttaatagaaatattaaca

SEQ ID NO: 305 - DNA, 477 bp, Homo sapiens
  Genbank Accession No. AA425325
tttttacacactcattcaaacctttattaagtacctaccatatgtacaatactgttccaaatattaagggaatacaaagatgaatttttaaatggtgccaaatcccaaggagtttacaatataataatagtaaaaagtaatttaacacgaactgtaggaagaaaattacaagtaaacatttgcccctgatggagaaaaatgaccttatttttaaatttaaagcataaattgccagtttggaaacactgctattacatacacctgtattagttcatccttttaaaatgatgctgattgtttttagaaaagaaaatgtcttatgctatattatctttatgattgggctccaaattttaaaacaaaaatttgcttaaagaaaaaaatatagatttataaaatcagattaacactgtacacagagagataaagtgtgttggcaataatatgtaaaaagttgaacacaactgggtctagcag

SEQ ID NO: 306 - DNA, 416 bp, Homo sapiens
  Genbank Accession No. AA425354
ttttttcaccagtgacaaaggagtcagcaaactgttggaaaacagagagaaattgtaataatgaaaaaaggacagagtttagtgaccaatcacttattttctttaaaaacacataaccacattaactttttgctttatacaaccatctagaaactataaaacagtaccacattgtgcatttaacctacttatcaagaagggaacttcataagtcataagaattctacccatataggaaggaaaaaggagacagctaatagcatagtcacagatacaacatgagtccaagcaagcatcaattcttcgacatcaccttttccatttaccagagtggagactgagaaagagagtgagggagaaaaaagagggaaggaagcacccacagaggactaatcacaatccatagttacttttga

SEQ ID NO: 307 - DNA, 305 bp, Homo sapiens
  Genbank Accession No. AA426372
gcggccgccggggatccgcgccgctcacccgccgccctccagctccttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggatggtctccaccaccagctggctgtacttgcccggctggttcttcttcttgctattcttcctcttcttag

SEQ ID NO: 308 - DNA, 486 bp, Homo sapiens
  Genbank Accession No. AA426374
tttttttttttggttttatacagaacctttaattgcaaagaacttgaaagcagccacgctggtgggtggcagtggagtggagaacccaccacaccctcccctcagtattcttcaccttcttcagcctcggcttccacggaatccacgcccacctcttcataatccttctccagagctgccaggtcctcgcgggcctcagagaactccccctcctccatgccttctcccacgtaccagtgcacaaaggcccgcttggcatacatgagatcgaacttatggtccaggcgagcccaggcctccgcgatggccgtggtgttgctcagcatgcacacagcccgctgcaccttggccaggtctcccccagggaccaccgtggggggcctggtagttaatgcccaccttaaatccagttgggcacaatctacaaactggatggtgcgctggtcttgatggtggcgatggcgcgttgacatctttcgggaccac

SEQ ID NO: 309 - DNA, 396 bp, Homo sapiens
  Genbank Accession No. AA426438
tttatgttcactacagatgcaagcatctgattttatttcaaatattttgcatccaagtttgcttacatacacagatattaaacctacagatacaaaaagctgagtgtacttacaaattaataactgtacacaggcagcataaaattctctttgtacatgacaaaaacattccgtgtccacccagggtgaacacagccacttcacaaacagggtgtaaataaggaggttcactaagtacaggaaagttacaagaccatattggcattttaacagccattcctgagaaagagaatgggaaagggcttaagagtcagacgagaggaaaagaggaaaacagatgacctcctacatcaggagatggagcagtgagaatacagaatagggaagcaatagtta

SEQ ID NO: 310 - DNA, 364 bp, Homo sapiens
  Genbank Accession No. AA426454
tttgacggtgtcaaactctgctttattggaatagagaatacaggcagcaggaatcacgcttggtgctggcagctccaggtcccctgcccccacgggctctcccacttgtctggatcccgggagacctccactttgaagaacaatatggggtgggagcttccaatgtgcattctgctaccagcctcaggattagcagcaagatgccaacagcaacagcaacagcaacagcaacagcaacaaaggactggactcgacacttcaggaaaggacgtgtagaagagaaagtcagacccacagtgtcacgtgttaacaacggtcccacaacagcagacacgacactggtgtgcacggctgtaccacctgt

SEQ ID NO: 311 - DNA, 133 bp, Homo sapiens
  Genbank Accession No. AA427622
ttttttttttttttttttaataatcacgtaagatgcgatcatacttctggcattttcaaaaagtgaaaactgtataaaaataaatattccccatacaaacacacacacaggccaatccaaggttagaggcatc

SEQ ID NO: 312 - DNA, 448 bp, Homo sapiens
  Genbank Accession No. AA427890
ttttttaaggatttgaatctatgtatatatattttacatttttcaacatttgtgttttattccattaacataaccatttacagttattccagaaatttcagtcatacacagtgctcttgaatccaaagagtggtctagtgtgttggcattttcatcaagtacagtcctagaaaatgtcaagttgaacaataagatattgaggcacattggtcactgtgtattctgaattctttagtatggtcagaggaagtagttaatatatttcatgttgattctttggctactcttgatttttgctttgggtaacatcctcatcctgggaacattcattaccacttaatagcaagataacattaaaaaaaaatccttcattgccacatttaatagcatgtttaaaaaggcagaggttgcaatgagctgagaacgcactactgcactccagcctggg

SEQ ID NO: 313 - DNA, 457 bp, Homo sapiens
  Genbank Accession No. AA427944
gcgggcccgcgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgac

SEQ ID NO: 314 - DNA, 475 bp, Homo sapiens
  Genbank Accession No. AA428243
ttttttttttccggaggagactgcactttaatggggtggcacaggacagcagaaccctcagccagcagccacagggcctgccagccagcacaacagagcaggtttttgcagtaatgatagatccaggcgataagcacaggtggaaaagggttgggtgcccagcccctcagtcccagtgagctctctgccacctccctgccagcatccggtacagattgggcggaatgtggagaaggttggccacagtccagagccaggagcccatggaacaacttggaaggtgactcaggtgaggctgtcaatgagggaatcccgcatgctggtggcaatggtgctaggctgggcttcattcagcttgaagacactctccaccactgacagctctgtgctggttgtgtccaggccacagaaggcacaccagtcattcaccaccatcccagcagcaatcacctcactgcctcggttcacagtcccc

SEQ ID NO: 315 - DNA, 159 bp, Homo sapiens
  Genbank Accession No. AA428325
tttttttttttgcacggcttatttcctttaatctttgcaacaacccaaagtataatagtaagcacagggtttttgcgtgatacccggtaggccttattaagaattagctcttattttcatcaaaggtagagaaaatgagtaactattgaggcccccgct

SEQ ID NO: 316 - DNA, 421 bp, Homo sapiens
  Genbank Accession No. AA428460
ccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggcccactggcccaccacagctgccatgccaccctctgcccgtatgaagaggtcactgggggatggagctggcacccacatgaatagctgtatgcactgtacttgtttcttaataaacttatttttaagcac

SEQ ID NO: 317 - DNA, 352 bp, Homo sapiens
  Genbank Accession No. AA429398
atggtaagaatttttattctgtaagaatcttcaaagctcagcatgaagatacacatctttcccatgggaatccaggctagagaaatgcaagaaggcggttccctctagagtctcctttcctgggagatgcagctccagatgggtgggtttctgggcaggaggggagaggagggtggtgtttattcaactgtttatttgggatcatgttatgcgtcttcaaaaagcgatataagagaaaatattggaaagatatttcaaaataagaattaccttgaagtaattcccataattaatgggtaacatttttgtgtatgtattttggctttttattgtaaaaataatgtattttcat

SEQ ID NO: 318 - DNA, 366 bp, Homo sapiens
  Genbank Accession No. AA429539
atcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaac

SEQ ID NO: 319 - DNA, 257 bp, Homo sapiens
  Genbank Accession No. AA429636
tttattttggaaaatgttaaaatttattaataatagttaacatcacatagttaattaaactagttatgtattgtacataatgacaacatcttcactagactgagtgctcaaggatttgagatgattcgctattcatcacaccccgaagattgagatccactgtatttacacaaagcaaagccatgtcagcaagggactgtcaacctgattctgagaacataaacattcaaaatttattttccagtgttcctttttgg

SEQ ID NO: 320 - DNA, 428 bp, Homo sapiens
  Genbank Accession No. AA430074
tttttaccattagattgtaaatttaatttaaaataaaatgtccctaaaatcatctcagtacttggcacactgacttaagatgtggggttggggagcatcccttaacacattctttgttttcctggtaaatactggtggaacaagacagctgagaatgtatgacatctgaccatgaacatatgacagctgtttgtgccagtcatgtccaaacccatggctctcaactccagatccaaaaactctccccatgttttagacctcccacaccagcatttaggatttcttcctctataatcttgctgggtgctggtcttggcagggcatctactggggataggtggtttggggtctcagtggtgggcaccggcttgttcttgcctcctctgcagctcctcttgccgcctcgcctgctgttcactcatgcaatc

SEQ ID NO: 321 - DNA, 335 bp, Homo sapiens
  Genbank Accession No. AA430388
gatgttttatagtcctctgtttcagtgccttccccatgcccatggagctgtcccaaaacccatccctcagtatttgttgatgccaaagacacgaaccccatggaactggggcaacttcggcagcagtacacttagcaatgaggctgtgttgatgaggaagtgcgcacatcatacttggtatagaagctggccaggagatagagcacaataggagagatgctgaggaacttgcgggaagaggtaaactggagcccatagtccatttgctcccagtgtgtcagtagccgagcctttccttggtcaggagtctcaaagggtgtccctttcaccgtatg

SEQ ID NO: 322 - DNA, 381 bp, Homo sapiens
  Genbank Accession No. AA430738
cggataaattttcttttatttccatactcttttgtgacatgtgtggcacaagtattcaatctcacagggatgttaaaacccacactcgaagggtgtccagtgtgcttaggaaatgtgggtttgcgcaatcacaggccaagcctgggtggtcctcggggaagctactcctccaggtcacctgccaggtggatgcacttccttgggcaatgggtgaccctcccaggacaaggggaaccagcagggactcgatggcaccacacagcagccacctgttctgacaatgtgacacagaccaactaatgccagagcccaggagaagccacagcagagctgcctgggttggtgtcagagcaacaggcagaagtgactgtgccgcccgtg

SEQ ID NO: 323 - DNA, 259 bp, Homo sapiens
  Genbank Accession No. AA431470
tttttcacacaaatcatcggcatttatttcctgggtcctaggtgtcacttatcctggtggacagggcagaggtggtcagatcgttttgagccaaaatcccttccctaaaaatggatctgtggagctccatgagggaacctcagagatgcacaatgacagtttagctaaaatggcttaaaaaatgtgaattgattgtcagctctctccatatctgctgaaaaaaggtttaaaatttttaaaaagtttaaaagtgttttct

SEQ ID NO: 324 - DNA, 489 bp, Homo sapiens
  Genbank Accession No. AA432162
tttttacagtttctttttttgcgttttatttttttcaaattgcattttacagtagaaatgcagaccactttggatagctatggctcgatacttctgggtgccctcctcctaagacatcctcttcttacattccactgaacagaaaaccatcccttctactggcatgaacttctgcccaatgaggcatttgctgcagcaagagcacagaaagcactctgtggatgcatgccagctgaaattgttataggtcacccgctgcacttctgggtcgatggcattgtggcatccttgacacaccacagcgtgattcttcacatagcagggcttgcacacgggcttgtcattgaccatcacgtatatctccccagctagaatgctatcacagtcaaagcagcagaagtgtttcaggtgccaattctggttttctgcctgggtatactcattgctgaatatcagctcgtcacagccagcacatcggggtttctcgct

SEQ ID NO: 325 - DNA, 367 bp, Homo sapiens
  Genbank Accession No. AA432292
tttgaggaatgagcaatttatttcaataaagagaaagcattaattttgctacagtgggaaaaaatgaactcaagagttgctacatttaactgtatccccatttatctctgcacgatgtcttatctcagtgtctcaattcacactaaaatattgaatgagaaatacaccacgttggctgattgcttgacatgtctgatttagggagacttctacaaccactcctctcttttttctcccagtaaatacttttgactttgacacctaccatattggaaatgacaggtgcccgagggcaagtgcatcaaagcagttaggattcgaatgcttgctaaggattatttttttaatggagcagttctattgaatc

SEQ ID NO: 326 - DNA, 470 bp, Homo sapiens
  Genbank Accession No. AA433922
tttgattttgtacatatttatttgaaaatatgctgtcaacatcatgacttttcaaaacttaaaaaaaaaacttctgcatgcatctcctaagaattagaacattatcctacgtaactcaattatcacttctagaaaaatcaaatataccacattctactacccattccatcttcctatttccccaaatatccccccaaatgtctcttataggtttttttatgaatcagaagctaataaaggatcacactttccatttggttatgtctcttgtcttaatctagcagagaccactttttgttttactacatttgctttttgaaaagtccagaccagggccaaaatgcacaaactatggcttacaacatcacacccctgcatagggccagtggaatgtgtgcaagatcagtttggcttcattaactatgaagtaggggatagcaagaagctctttttccatatgaaagaagttg

SEQ ID NO: 327 - DNA, 323 bp, Homo sapiens
  Genbank Accession No. AA434108
ttattttttttttttttttttttgccatatttttaaaatactttattttttacataatactgtcattacaaaaaaatacaaaaaaactactataaaaacattcgggggttgtcaaagtgagaaaacctaaagaccccaccccaggatctggctgaagcagtcttcccccagcttcttcactatgacctttatacaactatgggggtggggtgggatcacacaggcataaaagggctggaaattccccacacagcctccaagggtaagaaatgagtagcttcacatatcacaaaagtgggatttggaagtttgggggtggctag

SEQ ID NO: 328 - DNA, 506 bp, Homo sapiens
  Genbank Accession No. AA435720
ttttggttttatacagaacctttaattgcaaacaacttggaagcagccatcccgggggtggcaggggagaacccaccacaccctcccctcagtattcttcgccttcttcagcctcagcttccacggaatccacgcccacctcttcataatccttctctagagctgccaggtcctcgcgggcctcagagaactctccctcttccatgccttcgcccacgtaccagtgcacaaaggcccgcttggcatacatgagatcgaacttatggtccaggcgggcccaggcctccgcaatggccgtggtgttgctcagcatgcacacggcccgctgcaccttggccaggtctcccccggggaccactgtggggggctggtagttaatgcccaccttaaatccagtcgggcaccaatccacaaactggatagtgcgcttggtcttgatggtggcgatggcgcgttgacgtctttggggaccacgtcgccctgtacaacatgcagcaggccatgta

SEQ ID NO: 329 - DNA, 225 bp, Homo sapiens
  Genbank Accession No. AA435753
tttttattttttatcttttttattgcatttttactgccgctttttttgtttaaatatgtttttatacacaaacgccattgtgtttgaattgcctacagtattcggtacagtaacatgttgtaaacatttatagtggctatggtttggatatttgtcccctccaagcctcaggttgaaatttgatctccagtgttggaggtgaagcctaacgagaggccttcgggc

SEQ ID NO: 330 - DNA, 265 bp, Homo sapiens
  Genbank Accession No. AA435769
ttttttgagctttggacaaatttattgaaacatacaggcggctgttagcagagaaatcattccatgattgatgtgttacatttggccactaccttgaatgtataatttaaaaattatatttttcacaactaagcctttggccaaaaaagtcatttagcacatctttaaagatcaataagaaatggattttggacattaaaaagatcaagtcactgaattaaacagtagcaacccccattaatctagaatcccatagtgctgaagg

SEQ ID NO: 331 - DNA, 400 bp, Homo sapiens
  Genbank Accession No. AA435852
tttttttgataggcaaaagcttttaattgtatagattaaaataactttggacaaaaattaaaactcaggcagagaatgttttttttttcaacaacacaaactagcaaaaacaaaggcacagtaaacattgaggcagaaagtttccagcgtagagatatgaatataataatagacacaggcagggatgattaataaatgataaaatgtttacaggatgatcatcggaatacaggacatttctacttttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatggcctaaggtt

SEQ ID NO: 332 - DNA, 230 bp, Homo sapiens
  Genbank Accession No. AA436244
ggaaactgcagggttttattaacacgacttccaaattacatacaatatagttcaaacacatttttttggtacgaaatcacacaaatgaaacacacaacagtacattttcctttcaactacgtcattaccattcttcacacagatcctgaaaaagttaccacagcagttaacgcgaagtgaacaaaggggtggaacaggcaacggcattcccccaaggtaggtgtggtgtg

SEQ ID NO: 333 - DNA, 377 bp, Homo sapiens
  Genbank Accession No. AA436489
cgaaaaatatttttaaataaatttttttttcttacattctgatatacatatgtaacaaggtttatggcactgtaaccagaatcaaatcagaaaaaaaaaaaaaaaaggaaaaaggtgggaaggaaagtatttgatatattgttgaattcctttctatctccaagctggcaaatttgcactatttgtctatcattcagctgccagctctaacttgtttgcacacttaaaacatcatattattgcacaagaagccagtgaaggcatataatggtcagttcctcactatttcaaaaaaaatctcttaaacccagagaaggaaaaaaaaaaaaatccagagcatgaaacacacaaaatcaaaggtatcctttttctcctta

SEQ ID NO: 334 - DNA, 334 bp, Homo sapiens
  Genbank Accession No. AA436548
gagaagccatttattttgcagtcttcagtccaaaaaaagtcaacattttcagaatttttttatataagttgtaggtcatttttataacaataaactttctattatctatttatctctcacatacatttcatgtatcctgagtattatgttacaacaatctgctcttgatagtaatgttcctgatagattaaaagattgagaaatacttgaagaacgatcaaagatacaatgagcatggtatacttttgggttaaaatgtattctttgataactgatgtcatatagatccctaagtaaatcaaatatttaatttcctacatctgtctaccttagt

SEQ ID NO: 335 - DNA, 437 bp, Homo sapiens
  Genbank Accession No. AA436616
ttttttttttttttttttttttttttgtaatttaaactttatttcatatctattgttaaattacacaaaatcagtgaatggtttgtaaagctacaccaatggacagatgtttacagttgaaatcatgggatttacataatggcaaaaatgtatatgtatatttataacatcctctatatacaataatcagtatagacagagaaaatgcacttaatctttgcaaatcatgcacaccacagcaataacacaaaatgttttttctgtaacaagcttttccactggctcaggcttcatcctgctttccaacaatacctatcagttttaaaagcaaacattttcaattaaaactaaagaaaattgaaataccatagtgatctactaactattttaaaaacacaattgtacacaaaatagttttactctaaaacactgtgact

SEQ ID NO: 336 - DNA, 443 bp, Homo sapiens
  Genbank Accession No. AA436618
ttttttttttttagcagttaggtgacaagcaattttattttgcaaaacaatcactatacagcaacaaatacatttgcaaatttgattgaaaaacatgaactaactacaaccagccattgaagaaatgcctttctatggtaacaggctctagaattatcagaagaaagaaaccccccacagatttgtaacagtgtgttggaacctcggaatcccagcatacagagtatacttttatgttgatttttatttctttttgctaaagttgaagtagatttttatgattgacattttattttctgagtttgaaaataagctttttcctgcagagagtcttggccttcacctacacacccaagctaaaaatcctaggtgtaaaaaaactcaaaacatcaatgcttattttagcacgtcaatctttgaaggaatgcttaaaatttccttac

SEQ ID NO: 337 - DNA, 219 bp, Homo sapiens
  Genbank Accession No. AA436655
tttttaatttgctaaactttattttatacatacacgtttacatttactagtcatggtgtcaacttgttaacacaacgaagccctaatggacccgttttgaaattagaagctggacagttacaggctttggtctcttcaagaatccaattcacccctgggtttcgcttggcacacaccccaggagaacgtcgatgcacacagctgtgtagctgcaaacgg

SEQ ID NO: 338 - DNA, 423 bp, Homo sapiens
  Genbank Accession No. AA436823
ttttctgtataagaaagtgtttattcatggtggggcggagggtcacacatacaggccttggatagtgtgcagggactgcttccagctgtccttccagcgctgagcctcctttatctgagatgtacagtcatcctggatcctctttagctcctcctcaaatgatgctaaatatttcaggtacacagcatctcgggcttccacggccgccaggtggcccagtggtggttttggtggtggaaatcgatgatgttggctggagaagaatcttgttttggatggtgacttcggtgggtttgatccctggccacttcctgcttccacgttcaatcaggggtttctcactctcttccttcagggagagcccagcgagtttccttcgtatgagcattgataatttctgtttggggggctccatccctagag

SEQ ID NO: 339 - DNA, 316 bp, Homo sapiens
  Genbank Accession No. AA436841
ttttgtcagaactagggttttgtttattaaactggaaattatattaacaatgaaacaaatcacacggggcgggggtcgtcaggaagaggttttgaggctggggtgggaggcagccgggtttggctgcggctgctgtgaaccacaatgtcgtcgtattcatcctgggggcaaaggggaccaggcagaggggctcaggcggctgtcactttgcccaccacccatgtcctcatagagcaccctaagaattaggtctcgcctcaaagcccaagttcccctgctcctggctcaacctcccagtttcctagctctcagaact

SEQ ID NO: 340 - DNA, 419 bp, Homo sapiens
  Genbank Accession No. AA436861
ttttatttaaattattttattgaaggagataagttactcagatattaactggttgtaggcaaagggaataaacatggtgaagtcaggtttgctggtaaaggggagacagtactaaacgccctgcccaacaaatactcagaatccagggttttcatatttctccatggttcaatctctcacaggtcactttccattcaaaggattatggagaccaaataagacaggattctttcaggtatcaacccagagtctttaggtcttctctcagccaaggcatcgagtgaaaatacaatttatttttcggattcctctggaggattaaaaagtttctttcgcattgcaatgccatgctccctgctcttggtcctgttttctacgtactgtcgtcctagctactcaggaggctgaggtgggaagat

SEQ ID NO: 341 - DNA, 354 bp, Homo sapiens
  Genbank Accession No. AA437226
ttttgtgttttttttttttgtggtcttgacaatttattggaataaaaaacatgtatcacttattgacagagctttgtgttcaaggcacattcatacccatttcctcagcagaacctcacatccctacgaattagacaagtcagtcattattctgcagatgaggaaactgaggctccaagaggataagtgacttctccaaggtcataccactggaaacagcaaagtcagagctagaatttcggggctcctgagatatccagaattctttcactgtgcaatgctgcctctccaataaataaatgaacaaaataaataaataaagctttcaagggaaccctgaggaatcctccctca

SEQ ID NO: 342 - DNA, 453 bp, Homo sapiens
  Genbank Accession No. AA442830
ttttgcacataataattttattaaggagagttctcaggattaatacctattgagaaataaaaaaaattaagattgagaaaaagaacttgaactgtgaaacagtctcaaggaggccttggcaaatctcttgggcagctctgctaaaatggttctttagaattctgctttgatataggggcacaagcatttatactatcatatcaatagccatttgataaggagtgtcctagagaaagaaggtttcttctggtaaggcagctccctttgcccaaggacaattcataagtctcaaggctcaggagaaagacatcaggcagcaatactctcagggggcggacaaatgaaagcctcagaactgaagggtgtatcttggaggcacaaaagagcatccattatagtccaaccttttgctttcttcagctccacatactttatgtaatacattttagaaac

SEQ ID NO: 343 - DNA, 292 bp, Homo sapiens
  Genbank Accession No. AA443114
atgtacaaaaacattttaattgaaatacctgtataaaaaaatatgatctccagacatctcacttttgaactgaaagaacccccatctgcgatgcctgcacacaccgcattcacacaaacacaggtactgaataaattaaacgctcaggctctggccccaccccagctttcagagcccacaagcagactgtacaaagtcaataatttaaaacccaaaccctgggcacagtgcctggaagtgtcagggtcacccactccccttaagttagccactatacatgttcatcttctga

SEQ ID NO: 344 - DNA, 420 bp, Homo sapiens
  Genbank Accession No. AA443923
tttttcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcacccccaaaggggaaagaaggaatcttccaggcagagagaaagagaaaagacccaggcacggtatagaccagaggaaatttgaggcccccacccccccgcccccccccccccccccccccctcccccaggaaggcg

SEQ ID NO: 345 - DNA, 213 bp, Homo sapiens
  Genbank Accession No. AA446241
aggtctctgtgaggggaagcagcaggtgagggagaagggagacacaagggggagacgtggggaggcagggccaggggaaggtgacatatagacatggagtgggtcaaggaagacacatgcattcacggacctcagggccccttggcagggacaaacagatggactgactaggatgaggggaacaggacggacgtggatgcctcactcaaggcc

SEQ ID NO: 346 - DNA, 455 bp, Homo sapiens
  Genbank Accession No. AA446651
tttttcctcttaaattatttttcattctgattatattacaaagaaatgagctgtggaggtttggcactgttttccatcttaacagttgttctgtattgtaagattttatatgtgattcataatgtactactataacaagacacagtttttatatattactggaataatgcaaagaaaatgaattttcctttgggtccagtaattgtcaaaggaatgattgcagattcagaaaatgtgctttgtaataaccctgttaacataaagtatacactgaggaaaaaaataagtatggcacatatatggaaggattagttgtattagcaaggcatttcagggatggttttggttctttagactaagtaagatacatccaatttagacccccttcaaatccttagacaaatgggaatcacttggtaacataaagattattttggtgggcaggggctgatttc

SEQ ID NO: 347 - DNA, 451 bp, Homo sapiens
  Genbank Accession No. AA446661
tttccacaaaaatgtaatatacatttaatagcacattataaagttcctgaccaaagacgttgatttcctaattataatagcacagaaatcctttagaatttagtaaacgtaattaagactattcagaagtaatgaaaaaccaatatgataaaaacaaaaatcctccagtaaagaaggaacctgtccatttgagagaaatacaattgagaacttgcaaatgagacaagggaagatggcaatttggaactgcaatagaaataactatagcagaaacaaccatttaagaagttttagcagcaataagtatttattattctgaatgaaatgtacagttgacttttatataaaaatcatcaaaagtgctatattggattattttactattaatttaacccccaacagcatctattagctataactttaatgggtttttctttacttctgatacatc

SEQ ID NO: 348 - DNA, 380 bp, Homo sapiens
  Genbank Accession No. AA446899
ttttttttttagagcaaatcaacttttatctccaccgaaaagacccattccactggaggggcccgtgagctagacggacttgccgtccagccctccaagccccctgcgggcggccaggaggatccctgagtccagcttgtaaacaccagagccagccctggagcctcaggcctctggagtcacggcagcccctccagacccttggattggggacacctgaggcttcacgagcccgggcagagctgcaccctgggctgtccactcggtcaccccagtaccagggaccacctcgaagcccccctctggtcggcccacagagacctgctcaggcttcagcaatcgtgagtcatgattcgtgtcttctggaggaagcaggcgga

SEQ ID NO: 349 - DNA, 209 bp, Homo sapiens
  Genbank Accession No. AA447522
ttaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttga

SEQ ID NO: 350 - DNA, 449 bp, Homo sapiens
  Genbank Accession No. AA447537
tttttgattgcactaccctttattcctaggatggaaagtgtcctgaatcacatcccgggcccctgattccatgtgtcaaggcttccagcccctcaaagcgttggaataagcatgttcaaggaggctcactgggcaggtggccaacatccctttcaaggggatacaccataaagatgacattgtccaaggtttggagggcagggtgatctggtctgaccacctcaaagcccatgtagctgaaggcccgcagcagggcacctctgtcgttccgatcattctggaagttcacaaacacagagtccacatttgtcttctcttccacgtactccagggttgcagtcaaactttcccggttgccttgatccaaggcctgatatgggatatccaggaagagtcgacggtcacagagaaggccgtgcaatgggcagaggtctgggaggtaaggcgga

SEQ ID NO: 351 - DNA, 342 bp, Homo sapiens
  Genbank Accession No. AA447707
tttttttttttttattatacaaattagtagtttatttcttcctttagtattacagttccaaaacgtaacttgaaggtcagcacaggagctgctgtgatataaaaggagagagtcacctggcgccccctgcagtcctccagttgcccagcagcagtgggacgctcagtggcacacagtgggtctctgtatggcctcccacctgcaagggcttccccgggcaggcccagctgccagaagccccggaacacacaggaagacaacactataggatggcaggtggggatctgtgcaatacaaacatgtagctagaaaacccaaccgaggatctgtctagaatacttc

SEQ ID NO: 352 - DNA, 409 bp, Homo sapiens
  Genbank Accession No. AA447977
tttcatttacaacaatgcagtcatttatttattgagtatgtgcacattatggtattattactatactgattatatttatcatgtgacttctaattagaaaatgtatccaaaagcaaaacagcagatatacaaaattaaagagacagaagatagacattaacagataaggcaacttatacattgagaatccaaatccaatacatttaaacatttgggaaatgagggggacaaatggaagccagatcaaatttgtgtaaaactattcagtatgtttcccttgcttcatgtctgagaaggctctcccttcaatggggatgacaaactccaaatgccacacaaatgttaacagaatactagattcacactggaacgggggtaaagaagaaattattttctataaaagggctcc

SEQ ID NO: 353 - DNA, 416 bp, Homo sapiens
  Genbank Accession No. AA448228
ttttttcggttaacgagtctcaaatttttattttgatggcaaaaatcacacagggaagaacaaaaattatccatgacaaactaggagtggaaatgggctgggagacacagaaaatgggtgcccacagttcctgggatccctcctggaatcctgggtttccctcctaggaccctgcaaggtaccctacgtgcctcctggaacccccccaccccggaggtcccaaggaacccagtttgagaaccaaggctttaggccaaggacttccttgcacaagaaggtgcagatgtacagggatggttcagacagtggcctcaacctcaatggcttcatcctcctcctccagcaggctgtaggaagcatggctctggcaaggccgctgcagggggtgggccaacagtttcgccatgcagttgtgc

SEQ ID NO: 354 - DNA, 376 bp, Homo sapiens
  Genbank Accession No. AA448625
gagttatggtagtcatgagagcatctgatagctcctctgtgactcatccatttattttaatgacatctgaatatgacagtatattgaaaaaagaatgcatgttatttattccatactggggaagtgccactataacattgttttaaaaaatcttcaaaaatttcctattagaacctatcattgaattagaaaagcaagctttgccaaatgcctgattatgcctttactggtcctgctagctggcatgtttcaccaacttttccctagtgtttcctttggcactgttgagcccacactacaaaacatgaacaagtcccacaaaaccacactatgccctctgcttccccatcatgtggggaccatctgcctggacatc

SEQ ID NO: 355 - DNA, 409 bp, Homo sapiens
  Genbank Accession No. AA449749
ttttttttaggtaaaacaggatgtaaagtttatatacaagaatataatgtttatctgaaatatttacagtgttggttaaagcaatatttttacaacttttaaaggtaaactactatgtatattacaggtaagctacaatgggtttaatttgcaaaagttaagtaagaaatgttttaaacaaggcttaaagtactcaagtcaattataaaatttatatcttttgccttttacttgaagaaatcatgctatagaaatggttaatgtgcttctaataaatggaagtattgtagctggaatgtgatacatgtaacagtttaagttcccattgaaggtataaaatgatgaattgttgtaagacttagacactgagtctcagtctggagctgatgaagatgttgagataacagcc

SEQ ID NO: 356 - DNA, 112 bp, Homo sapiens
  Genbank Accession No. AA449791
gaaaggagttgagtgatttattgagtgcttacttggtgccacggcatgtagctagcgtgcttacctaaatcaaactcatgtggatccctcagcaaccaacccctgtgcagga

SEQ ID NO: 357 - DNA, 435 bp, Homo sapiens
  Genbank Accession No. AA450073
gcggccgcccagcgccggttgccgctccagaacgtgcccgtagctggaggtcatggtctcccccaccgatcccacccacccccctcttcccgctcgaatcaacaccaaacgctgtgggcgcgaggggggagaggagccgagtggggaagaaagaggggggtagtggagagagagagagagagagggaggaagagggagggaaggagaggaaggccaaaaaaaaaaattggaaaagagggcggggtaccccttctgtagagcagacgtgtctgcaccagccgccttccgcagccttggttgctttcctgaggccaagtccggcgcggtccaaagagataatccacactaaaatacaatattaaaaagtcaccctatgttcaagtcaggagaaaaaaatcccttccaactctccaaaagtgtccacacgcacagact

SEQ ID NO: 358 - DNA, 386 bp, Homo sapiens
  Genbank Accession No. AA450114
atgagttcaatatttttatttctttacaatgatttcagaagagattacaaagagattaatatacttaaagaatcagactcttgcaaacagtgacatcattaaaaagagcttattttcattaacatgtgattaacaggaaggagatgattggtgagttttcttcgtaaccaggttcactgtggataggaagggcctgccttccttcccaccatggagatcctaaaatcacaagctccagcctccatcaatgatgacagggttaccagttacataagcagattcatcagaagccaaatacacgcagagcatggctatttcttctgcagttgcgaatcttcccgtcttttgtctcttcaggaaatcattccgtgcctcttcaggatttc

SEQ ID NO: 359 - DNA, 431 bp, Homo sapiens
  Genbank Accession No. AA450127
gcgaccgctcactccccttctcctcctcctcttcctcttcagtctccaacgactctgcccccgatggtcctcgtgggttgggttgttttgggggggttgtgctgggggggagggggttcaaatatttattgtattttttgtttgtggcagcaactcaacagattctgctgctgggaagggcctcagcgttcctgaagagagatgtaggggacccactggttgttgccccggctttcttcgcagtagctggccacctccaccaagccgtggctcttccaggcgtccgtgtgagggttcgtgaccaggagacaatgcaggtctcgggcctcggtggtgccctgggtctcggccggctctcccaggagctgcgccaggcgctgcatgcccgacacccgcacgatgttgatgtcgttgtcacagcagaaggactg

SEQ ID NO: 360 - DNA, 282 bp, Homo sapiens
  Genbank Accession No. AA450324
tttctggttcatgaaatattttacttaatagccaggaatgacttatgttaaaaattgtgccgggcttataagtatctctttgatctggccaacagctcttcctctcttttctaaaaacttcaaaatgccctcatttctattttttccctttcagttaataatttagtttaaaagtgcacacttatggttcagtaaatgggctttgtctagtagtcacagatgctgagtatgaatttcaatggatccgttagctttactactaagatcttgctgagatcagag

SEQ ID NO: 361 - DNA, 254 bp, Homo sapiens
  Genbank Accession No. AA450373
ttttttttttttttttttttagaagggagcacctttatttggaaaacagtaatttcaaaatcatctcccgaactcagaatcgatgggtctgggtagataccctaagtaaacaggtgaaatcttcattacttgttcacttattaagtaaaattttaaattaaccgattatgtacaggagtgtttttcacatttcctgataagaatcacttggaatgccctgtaaacacagcttcactggagattaatcctatcaa

SEQ ID NO: 362 - DNA, 147 bp, Homo sapiens
  Genbank Accession No. AA451836
tttttctgaataaataagcatcaattttattgaatcatgaataatttaagactggtacaatcatcagctttattctctatgacatggggcatgatgtccagcagatcattggcaaatccaaaaacctcatgacaaatgaaaattaaa

SEQ ID NO: 363 - DNA, 386 bp, Homo sapiens
  Genbank Accession No. AA453433
tttaaggagcaaaaggctttattgataaatatgcagatatgtctgtccacagggacctgctgtggaggccatgaccaggctgcagacctcccactgcctgggttacagccaggacatggccctgtgcagaccctgccacgacagcccagccgtccaccacccgcctcatctctgccaattgtgctgggggcagggagaggcagaggcccgcctcaggcttcccaagccctggggctcacgggtggttccctcccttccaagggagtggcactgtgcccaggggagagccaggggatgggggcagaggagggagacagcagctgcttcagaccctgagcagaaaaccagagtgagcacagctggcagcaccagatgacagatctggg

SEQ ID NO: 364 - DNA, 346 bp, Homo sapiens
  Genbank Accession No. AA453435
tttttttcacgttatgaagatattttcctttaatttatcaaacatttcacattcatgaagtcatttacttcagagcaaatgtaagcttataatattaaaaattaaagtattacaatatttacaagatggttggcaggggacacttactagtataaaaataatacaaatattgtattttcctcttatctgccagtaaaaatggcaaacagttttgtctttctgaagtttctagtcaataaccaaagatgaggagcccctaataaagtgccttgccctgtatgctccactgtctatagctttagaccctcaacattcttcttcaagttcagcagctctttttcttgcc

SEQ ID NO: 365 - DNA, 362 bp, Homo sapiens
  Genbank Accession No. AA454016
tttgacatttattatttattttttgaattttcaaactcctgaaaatacagagaaagacagttttaaattaaattttaaattaaattaaattaatgcagtattcttcatgctgccaaagtagggcattgtaatagaagacgtaatgatcgcaaaatgggaaatgtagttcaaagtacgttcctactccttttaaattccttgtggttgggaacttacttctctgcttaccttgaactgcttaatctgccaaaattgaacaagccaaagcatttaggcatggttaaggtacggaaaattcaaaatttggataaactctgaggcagatggaagaaataagtgccagccctaccacctgcctcagc

SEQ ID NO: 366 - DNA, 379 bp, Homo sapiens
  Genbank Accession No. AA454908
ggaggaggcccctgtgagcccactctggaacccttcctggaaccctccctactctgtccccctacagacaaccaagcactaatccccttagtaccaagaaaggggagccaggatttagtcctggcccagcccagagctgggacctggagcacgatctgttgacttccctgggtaggacactgccacctctgggctcaggtcctcatgcctccaaatggcatctagagtttgagcagccttcttggctgaggcaggcctagcctgtggagcgggctagggccaggagcatttggtgcccctccatgttgcaatgcaaacaccttcaccactggggcagtggggagagatggctatattaataaaataacgtgtgtctttc

SEQ ID NO: 367 - DNA, 398 bp, Homo sapiens
  Genbank Accession No. AA454928
aagtggataacgtatcattaaaaaaatgtgtgcatgtgtatatatatctatacatacgctctgactttcaaaatttgttagattctgctagtaaaactgttagaattacatcaaaatgcagagggccatgtgaattggccctccattgtgaatttaaacaattttatttatttaaactttcctacatcttttttttttttcaatctctgggaacagactacctctgtagaacaaattggttatttttcgtgaagcaactacaatcactgggattcattcaacttaagtgacaagacaatagccttctactatttttgcttatgattagataaatcactggtctcttttcatggccttctataatagcagaacaggtttcctaaattaaaaaacagaac

SEQ ID NO: 368 - DNA, 426 bp, Homo sapiens
  Genbank Accession No. AA455001
tgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaagacataaatttaggtctatgggctagatttagcccacagttgccagtttctagcgctaccaaatgaatgaataaacatgagcttgcgctcctagcc

SEQ ID NO: 369 - DNA, 256 bp, Homo sapiens
  Genbank Accession No. AA455070
ttttttttttttttttttttccagtttcaaagaaatttaattattatttacacagttaaggaacaggtgatacattttcatttgttagaaactgatctttctgtaataaaatagattttcaattcagtgtatgtcattattactgctaaggaaatcttagcccttgtctgccttaaaggaatctttatttaatttactgtaattattgctgtgtagtcactacttttgttaatttctcaaatcacttagatgatgg

SEQ ID NO: 370 - DNA, 465 bp, Homo sapiens
  Genbank Accession No. AA455381
taaagaaccaaagaatcctacaagcccccgtaacacacatacttgagttccagatactcatcaatgccatacttggacccctctcgcccaaggccggactgcttcactccaccaaaagggcactccacagaggaaattaatccttcgttgacgccaaccatgcccacttccagctgctctgccactctccagatctgggctgggtcttgagagtaaaaataacctgctaacccaacatcagctgcgttacggattgctatagcctctcctctgtatcgaacttgataactggtgccagagcgcgaaagtctcttcatgagtgcacagcatgtcctgggtgacattgcacagcagggtaggctcaaagaaattttttccaagttggtgtcgttttccacctgtcacaacggtggcacctttagaaacggcatcattcacctgtttctccaccttttctaccggttt

SEQ ID NO: 371 - DNA, 433 bp, Homo sapiens
  Genbank Accession No. AA456147
tttttttagatttttaaaaactattttaatacaagattaatagcaattttctatccaaatcagaaatgaaaaatcttaacccaaataatattcatttgacagtcacataaaattttagatttgattggtgcacacatttatcctgcatatatattatgtatatgcacagagagacctcactattatgccattgttaggggtctttttttggaagtacctcattacaaggcaatgtcaaaggttccagtaactactcaactttgaatgaagttcaaaatgtccccatgctaagctgagtctgtgccatagcaaaccatgatatagcaagtctccagaatgtgtacaaatcaatactctgtttgtataagttggtctaaaactaaacactggctaatgtctccaacaaggaggaacacattacaaatttataagt

SEQ ID NO: 372 - DNA, 437 bp, Homo sapiens
  Genbank Accession No. AA457148
aacgttttaacttcttttattttattttaataaaaatatgaaaaagatgttttcttcctaacatgaacagtcctactgcagaacttcttttattttattttattgagacagggtctcaccctgtcatcccaggctggagtacagtgggacaatcattactcactgcaacctcgaactccccagctcaaacaaacctcccatctgggcctcccaattagctgggacaactcctgggctcaagtgatcctcccgcttcagcctcccaaagagctaggagtagacacatgagcaacaatgactggcaaaagccaaagtcttcctgttggtcctcaaggccctcaaggtctgacctgtcacccgttcaccctgcttcagccacactgagctccttgtggctcctggaattctgcacactctcctgctcgaaggcttttatg

SEQ ID NO: 373 - DNA, 355 bp, Homo sapiens
  Genbank Accession No. AA457235
aagtgcttaagatggtgtttaatacagcagggagccaagatacagtagtaggacacagtaaagaatgtggagtgtgtagatacaataaagaattcattttatgatctgccacctgttacttgacagaggagtaagttagggaaataaatgactcagttcttcatacatgcaaaggtaagttagttattacaaaagtttttgctgttgtttgtgctgaaagaaaagcatatgcatttaaacattttttaaaaaataaatcactcaataggcttaagaaaaatactttagttcatagttcattgatctgacgttttgatttaagatcaggggatgaatccaggatgaaaaccaaaga

SEQ ID NO: 374 - DNA, 408 bp, Homo sapiens
  Genbank Accession No. AA457407
  unsure (1)..(408): n = a or c or g or t
agaaggaggacaggatagttaccctcatttgtcgataaatccagtccgtgaataccatcacattcccgtacactcctggtctgtaagctttggcacagcagagaccccagcttgtatcccctatcagccaccagatattgttcttcgaagtgaccagaggccctccactgtcaccctgtggancacgacaaggtacagagagcagaaaatcaagtcacaatctgccgcacaccactgaccaggcctagaggagttggggggcgggggtcgcagtgtgagttacgagtgactgtgtgggcttcgaatctccaccatcaaggggtgatggtaacagagatgtaacccccaaagagatagcccccatcctgaattttaatctgttcaagctaaaagttactaaataaattg

SEQ ID NO: 375 - DNA, 354 bp, Homo sapiens
  Genbank Accession No. AA457566
ttttttttttttttttagagatcataaatacttttaatatcagataaatcattaagaaattgcattctgtacttgatgaccacacgggaaccttgctagagtcaagagaacttgtcactagtaattatgaagacacctttacggtgagcgttattaaaaccctactagaggttttgggtgggactcaagagcaaggggtggccacctgtggacgagggttccctgttgttaacagaacacgttgcccacctcgcaagtatgcagcccaatcagtccccagggtctcggttcccgttgcgcccttccccatggccactgcgctcattcatgagcctagggtgatcaggcctccgg

SEQ ID NO: 376 - DNA, 372 bp, Homo sapiens
  Genbank Accession No. AA457675
ccagtctctctgccacccccctgggttcccctttactcccatggctggaggtaactctcttgcttaagctctggctctgtaaacccaactcttgcttttcattgccacttggatgtctcaaaggcacttcaaacgtcccaagcagatctccttttctatacagccatccacaggttgctaggccggaaacgggaaatgatctgaggtgctctgttctctttgcgcacacatctattcaggcacgaaatcctgtcaatcccacatcaaagacagttcctgaatctgcctctccctctctttatttccatagcctctatgttactccaagccaccttcatttctcccctgactattgcaataatcccctcctga

SEQ ID NO: 377 - DNA, 394 bp, Homo sapiens
  Genbank Accession No. AA459272
tgtagaaattaaaacactttaatataaacatttccagaatatagactgaccttatatcagtactttttgagaccgttttaaaactatatatcatctaagtttattatagactgtttcattttccactttcagaactagaaaatgcaaaaatacactgcaaattagatttaacaaagaaaaaatcagtttaagttatttcatacatattccttggagaaagctgagacacataaacacagaaaaacaacaataaaataccaccaacactaacacaaaaccaaggaaagaactgattttgtaacgcttggtaattctgtcctttaaaataaattatctcccatgaataaataattcactatcacagcaatttgatgagcagaagtagagacaactt

SEQ ID NO: 378 - DNA, 359 bp, Homo sapiens
  Genbank Accession No. AA460377
tttttttttcctatgaaaattctttattgttaatttctttctccaacagatatatttttagttgaaatatggagccacagcaacactttgacttttcctcttcagaagatgagacaggccggggtcatcattgttacaaaagcaaggcctgtgattgtgacaaggacaggctggggcagagaccacacgctcaaccaggtatccaccaggtgtgggccctttataggagctacaaagagggggcagccagcaatgtggcctcgacacctgactccaggcactccgacctggaggagggagatgaaagaactcacctttccccaggggctcagccagacctccaggcccctgagcgggga

SEQ ID NO: 379 - DNA, 402 bp, Homo sapiens
  Genbank Accession No. AA460651
ttttttttttttattgctttctaacatcttttacttcttgaccttttgaaacatccaaaaattagtagtagtataatctatgtcacaatcataatataacagttaagaaaaaacataaaatgaaggcctaaaaagatctttgttactcatctagaattatttggtataacagtattttcccatggaggaagacttggatttcaggcattaaacaacgcagaaaaaaatctcaaggcatcacagggagagggagataacttttgactctggtttcccgtgtttcaggccaggaagagcaaggggagaaaaatatttgtccatgggaacaagtaatcatgctctaaaggacaatttcattcgaatccattcatttccttttcatgcaaaatttcaaagataaag

SEQ ID NO: 380 - DNA, 384 bp, Homo sapiens
  Genbank Accession No. AA460914
ttttttattccaatgaataataatcacactttaatataataacaaacatacaatacattaaagttagaacactactttgataagacaatcatactcaagctaagatacaaggtacagacatactgaaattgtaaagtgaccattttaatgtttgatatttacttctcttattggcacaagactaataagatagatgggttgtattactcttaaaatctaagacttctcctctagctcagggaaaatactggtggaaacctgttttacccaaaagcagctttaatatctgtttaaccaggttattctataataagaactccattttaatgcacgttatccattacaaatgtgtgagatattctataaaacacatatttaaaggtc

SEQ ID NO: 381 - DNA, 391 bp, Homo sapiens
  Genbank Accession No. AA461300
tttgttttacaaaattttatttttcaaggttgaacaatgattcattgtaggctttcagatgaaacaattagcagtcttgaagtacacattgaatacaaattaatttgatttcagtaggcacatttcttggaacaaactgaagagtacttaaaagatcccattgaatgcatgtggcattattcctagtttacggatactgtttgaactaaatgaatcttgggagagggcagttagtaattaatgcatttagaaactgatagcgctaaaatattaaaacttatgcattccaatgtttacatgtgtatgtgtgtgtgcacatgtgattctgctttgcctgttttactatcttaatgattatcccttcttactgtttcctctgaggatcttatct

SEQ ID NO: 382 - DNA, 298 bp, Homo sapiens
  Genbank Accession No. AA461453
ttttttgaccaaaaaaggcaactatatttaaagtaaatgtatgtgattcttgtcacaacaaatatttgcattttctcagcggcacgtccgggacctgggtggctccgacacgccaggcccgggaaggacccggcaccctcccctgaacttcctggctactcatttccagcgaagtttaatctatttttaataatcgttcagttttcaaggaaatggaggagctgttttttcccacggagcggcggccctgggaggggccggcccagcaggttccggccgcgatgccgtcagcgccttc

SEQ ID NO: 383 - DNA, 353 bp, Homo sapiens
  Genbank Accession No. AA461618
taagttccaggatccatgtgcaggatatgcaggtttgttacatagggaaacgtgtgcctcggtggtttgctgcacctatcaacacatcacctcggtattaagtccagcatgtattagctatttttcctcatgttctcccaccccccgccacagcccctgttaaattaatttcttattctccttaatattccatacacattcagattccttctcccctacaaaaatatttgctattttgtccttgctatttctcatacttagatcattcatacactatatttattttttcattaaactattttaaaacctttggaaaaaaaaaaaaaaaaaaaaaaaaaaaaaaaaaaaaaaaa

SEQ ID NO: 384 - DNA, 420 bp, Homo sapiens
  Genbank Accession No. AA463311
caccagatgaccacggcagggccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggt

SEQ ID NO: 385 - DNA, 253 bp, Homo sapiens
  Genbank Accession No. AA463693
taactcccagtcaccctgttttatttcaaccatggagaaaagtacagaggaaaggctgcatatggagagactgtcgggctgacggtgtcacagcagatccgagtccacgtgtggaaacagcagccgcccggccctgggtgtttcctccaggaaaggcctggtcagtgaatgcctgcaggcagcagggtgtcaggaatcacctgcccgatgccagcgctgctcttgtctggagggccagactgtcatgaagtca

SEQ ID NO: 386 - DNA, 346 bp, Homo sapiens
  Genbank Accession No. AA463726
tcagagaaaactcaaactttattgagagaattttcaaattttcagtcacattttcaatgtgacatcagccatgtgtgtagcttcagcttgtcttctttttaacttatggctgcccatctcctgcttctttagtcttagcatgcttaggattaggtggagtcttctcttttacatcagagccatctccacgctcactccgagtcttttccagatccatttcctggcaatcaccttctactttacgttcttcgatcggaggtgttccttctctctcttgtccaggttcaatatcctgattgtcagttggtggttcctcttgctgagattcaccgggagccacgaatgc

SEQ ID NO: 387 - DNA, 403 bp, Homo sapiens
  Genbank Accession No. AA464598
tatgtggacttcttttaaacatttattaaaaaagcaaaatgtatgttcatctcaaatctaacagttaaaaatggtaaagcaatacaaacaatgtgttactagcagcatccagtcgttagaatctctcaccctgcttctcggtctgatctgtgcaagctcagtctcttctgaccctgcagctacctccatccctcatcgtagtgcaggccaaaccaaattttataaaattaacaatttaaggttaaataagcttaaataagggtgttaaatacaagacacttcatcaaagcttctgtacaaagataaacaaatctggcattgtacaagtggttccgctggctcacagcacacagggaagttctagtgagtaagcagattcactctcatttctttccagcagagc

SEQ ID NO: 388 - DNA, 315 bp, Homo sapiens
  Genbank Accession No. AA464728
cgggtaaatgaatatgtttatttaaatatgtatacaagcatggccctaggagcagcagatacactttcccaaaggtggttgcttcctttaagatattgcacaatagaaaataaactcttgtcaatccttaaaattagtcttcaatgctatgtattttagctatgtaacttgtactgtgtcaacagtgaaccttattagattcacggtgtcatcgaacttatagcaagataaaaatcaatcagtaggaatgtcattttaaaaagtaaaatagtgggacggttgtggtggctcatgcctgtaatcccagcactttgg

SEQ ID NO: 389 - DNA, 302 bp, Homo sapiens
  Genbank Accession No. AA465093
gcacaggaaataattttttttaataagagaacaatgagggtcctaaagtagaaacataagccagaagaaatctaaaaatagcttcctgatattttattttaaaatatttcatttaagctgcttttggttgcatgccctgatctgtagaagttaacaaggaaataaaatttccaagtatttaaaaaatttactcatcttccataaagcgacttttaatgtatcaacacttaaaaatacacagtgacttaatgaagtatcagcacaactgcatagaattgagctccagagaattatacactcga

SEQ ID NO: 390 - DNA, 296 bp, Homo sapiens
  Genbank Accession No. AA465394
gtttgtttgtttgtttttttgagacggggtccgctccttagcccaggctggagtgcatgctgcatgtttccatttatatgaacctcataatcgaacaaatctcatctattgtgacataagtcagaatactggtcttgtgatataaatcagaatactggtcagggagagaatctgggtcagagcacaggagggcttctaggatcctgatctgaatagtggttatatggctgtgttcaatgtaaaaattcattacgttgtacccttaaggattttgcattttgtgtgtattacacatc

SEQ ID NO: 391 - DNA, 519 bp, Homo sapiens
  Genbank Accession No. AA465491
ttttttttttttttttttttttttttttgaggtttgcagcaatgacgtttaatacttctggaatgattaggaatctgagaacagaccgtgggcggctatgctgacagggctcccggatgtggaagctgggccctgctcccttgcaggggactctgcccagctggaaggggcagcagctcggcaggccctgaccggcaagcgggcatgcaggcagcccagcagcagctgagcttccagaattgcacagcagtgggcctgtggagaggctggcgtcaactgaaggagaactggagggctgacacgcttggctggcgggcaggcaggcaatggagcagagggcacgggcctacgagagggcggggcggccagcggcaagtgggtggcccgaaggcactgttcgccgccggtgccactctgcaggctgtagtggtcgtccgcgtcactgctgctgccaacactgtccagctcaccagggccaaactccatgccctctatgtccacttcttgctctgagtcgtc

SEQ ID NO: 392 - DNA, 399 bp, Homo sapiens
  Genbank Accession No. AA469954
tttaattttgccaataatttatttcatcggcttaaatattgtccatgcctaagggcctctttgaaaatatgaacatccctaggcagggtggaccactccccttaaaataaatgtgatagcaaaatattttcttcctaggcaggaagggttcagaattgatttggaaatcagagatttctcaaaggaataattaaatctgttcacagtaggagaaaagtaacatatggatattagtgatttcgtttacttttattaagaaaagagactattagaaccatgccctgggaactcagggtgtaaaagacagtgtcacctcacaattctgcagaggacgacccctaggcaaaaatgttctactaaataggacaggtttgagtacaagggagcactggatgatga

SEQ ID NO: 393 - DNA, 358 bp, Homo sapiens
  Genbank Accession No. AA476594
tttttttttttttttgacatttgtattttaataaaggataataaaagccaaattacagccaactgttaaagctttttttttttttaaattctatggtaacaaaatcagttcaggggctttttttctgaacaaatgatcatgatccctcagtctttcccgtggcatgctcctaaaacaaccctctatgtctaatcagtcacctaagatattgagtggcaagtctttcacagttgctgcttataattcctaaatggtccatattgagtattttcatttctgggtaagggaaaaagcattttggtccattaattcacccactcgctcctggaggacattaaccaattctgctattacgaag

SEQ ID NO: 394 - DNA, 295 bp, Homo sapiens
  Genbank Accession No. AA476944
tattctttcaaaatatattttattagcggcacatggaatgtcaagttaagcaaattctttccagagagaaggtgagcctgacagactaaaacgttgagcacggatgatacagcagaaataacatttccagtgtaatgagagataaagaggaatactgcccaccgaggaaatgactttcttcaccatgctgaccacactgcacagcgcccgatccggctggtgaggatggggaggtgggaagaatctcaaagcactggacagggtgaggactcaggaagtcacggggtcagcccta

SEQ ID NO: 395 - DNA, 246 bp, Homo sapiens
  Genbank Accession No. AA477119
gagctcccgtgagtggttaatagggtgatagacctgtgatccatcgtgatgtcttatttaaggggaacgtgtgggctatttaggctttatgaccctgaagtaggaaccagatgtcggatacagttcactttagctacccccaagtgttatgggcccggagcgaggagagtagcactcttgtgcgtgatattgatttcacggaggatggtggtcaagggacccctatctgaggggggtcatccatgg

SEQ ID NO: 396 - DNA, 437 bp, Homo sapiens
  Genbank Accession No. AA477767
ttgttttttttgaggttatttcctctgagcagtctgcctctcccaagccccaggggacagtggggaggcaggggagggggtggctgtggtccagggaccccaggccctgattcctgtgcctggcgtctgtcctggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgtggggttctttcagttcaaaagtgagatgtctggagatcatatttttttatacaggtatttcaattaaaatgtttttgtacat

SEQ ID NO: 397 - DNA, 269 bp, Homo sapiens
  Genbank Accession No. AA477833
gctcttctgcaattcggtgttttattctttccaaatctcaggcttatgcacaagatggaagagcactgttaaaattaaaaaatggacctaaagtggcttggctgacgtggctagcgggccactgagccgcgggtcccgggtcccaccctgctgtggggggagtccctgggccctggggctcttggcactgtgtgacctgtgtgcaccccaggtgaccaggcgccgggacccctgcaggcagagcaacagggcaggggttggccctgcgg

SEQ ID NO: 398 - DNA, 401 bp, Homo sapiens
  Genbank Accession No. AA478615
tgaaaggtttaaacgctttattgtgcccaaaaaaaggcccatggaatgaagggaagagccgcgcagccgtgagccgggagcgattgtttgtcgcgcacccaaaggcaaggagggtggggagctgggaaaggatgcgcggcctccggtgccccgcgcgccatgggcccggccaaccagcgaccccgcccggtggcgaggcgcggcctcggccatcggcgccctaggggccagtaaccatgacgacggccgttgccaaggccgagagccaatagaggcgtcgcgggcgctgtttcaaaaacctaaagcaaacaacgaaaaacgctacatcgttgggggaggggaaagactgagaggacccggggcccctccctgaggctcagaccaggcctcgcggccccggc

SEQ ID NO: 399 - DNA, 451 bp, Homo sapiens
  Genbank Accession No. AA478778
gggtgtggtgatgtatttattcataatatattttcagaacacattaataatggagaataacacttattcatatactgaatataacttttcctggagcactctagagcttgtttggagttggagaatactgccaggcttttcctaatctctttggtctttggaagtgggcagggtttctcaaaccaagtgtcttccatgggccattggaaaggcttcccttcatcagcttggaggggcagaaagaccatggcttcagcacttccattttggaaagaagtaacaaaaaagtgaattaatgagcaatcggaaagactcaaagcattttgtactccacagttcatttcttcacacaaacgtccattactgcagcgggcatgaaaaccggcaggatgttaggctcatggcctgaagagaagtcacatcaccagccgatgttttcatgcaaaaggca

SEQ ID NO: 400 - DNA, 378 bp, Homo sapiens
  Genbank Accession No. AA478962
tttttttttttttttttggtcatactacatttcactttattattattaacatttatcatacatggttactattccaatctttcatgcagacaaaaataaacaatataaaatacataatgcactttgataattttaaccatacataaaatatggagtaatggaagctatgttacatggatattttacaaaggaaaaaaagatgacttttataataacacatccagatgaaatttatcattaaattttggatttcatatgatgttaagtatggatatattcaaaacaattactatttatagaaccaatttgatattttgtcatttaaaataatgaatactatgtaaatgagtacttataaaaatatttttaggcaaaaag

SEQ ID NO: 401 - DNA, 421 bp, Homo sapiens
  Genbank Accession No. AA478996
gttatgatatgttcatttatttttcaatgcatccaaattcctcagatttcaaaaagaagggatccttctaagtgttcatgctggatcttactggcttctagtttgagatctggttggtagtgtattaattaatttaatgcttacgtggagcttggtagggaaaggaggttggtgggcactctgagaggcacattgccagcttccaaggacctttgcaaggggcagctccagggcccctaccctttctctctctctctccctgaggcagggggctgaagatgtggccaaggagagcttcaggctgtgtctccattggtaactgcctttgttgcacatttccagaaaaccacaactggaaacctcttctgttgggacatgaattctttttcctttgggaagggcaacagaagcaagtggtgat

SEQ ID NO: 402 - DNA, 372 bp, Homo sapiens
  Genbank Accession No. AA479044
ttcttttttttttttttttttctcatcaaaacatgatttattaattttaagcaagagtaagcatatgtgatagtggccagcttggggatagaactcttcctggttgatgcacagttcagcacctgttgggtcttggctgttgggatgataattcttttgggtgaggggaacagccgtggtcaaggctgcctgcacccccatccaggcacaggaccctgggcaaagtctcaaaagaggtagtgtttttactttcgcaccaacaatacaacataagtattgggtacaaaagaggagatttccttcccctctacctcaacgggcaaaaggccttccatcttcagaagaggcttgtgaggaccatcggttgatgac

SEQ ID NO: 403 - DNA, 501 bp, Homo sapiens
  Genbank Accession No. AA479286
taagcgatattgagtatgaaaccctggatgagcaaaagggatcttgaccaaagggataaatgtctgataggaacctgccttaccacacacaagcagagatgtcagaatatgtcttttcaaaatatgtttttgttgttgttgttatagttttttgcattccttctacaccagagaatgaagacccagattcttagaaataaagccaaactggcattcatctggtttctcacagcatcagtttgataaaaagaatttcactgtattttttttgtccccatgtattttgctttttccaatacttccaattatttgttggtctcactaactcttcaagcctggtgtggctgtaggaacagtaagcacagtggcggtgttgataactgacgtgatgtgggctaaacagacatgttaagtcaaaactattctctggaggaccatggaatgggcatccctctagactatgggagggtgaagtggaaaactttaatgaatatagacagc

SEQ ID NO: 404 - DNA, 375 bp, Homo sapiens
  Genbank Accession No. AA481057
ttttttttttttttttttctggtaccagttttatttataattaaccacatacaaatcacttttctacaaaataatggttaacatctattccttaattcacagaaatatcacaaaaccaaaatccttcccacgatatattactatttagtctaagctttaattcaaaggttgagaatgacgaattcaagaatttctttcatacataaattgctttccttagttctgcagatgggtaatctgtttgagataagcactgtcatgtttcaaccttagagaacaaaaagctatcaacaagatagtggtaaagaaaatgctagccaaaaaataacactattgagaaataggtgcgtattaagtgcaatacttacaacatct

SEQ ID NO: 405 - DNA, 403 bp, Homo sapiens
  Genbank Accession No. AA481407
ttttttttttttttttttttttttttcaaagggagttttaaaaaaatttattggctatgtttgattatccacaacagaatttcccttaattagcacaggaaattgaaagttggttataatttaatatctctgctcttgtcttcaacagacatactcagcatttatacttgtaaatagaattgagtttccattgtttcgtttcctgtttttgtttccttaggaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattat

SEQ ID NO: 406 - DNA, 244 bp, Homo sapiens
  Genbank Accession No. AA482107
ttttttttttttttttttttttacctgtttacatgtgtttaatgctttgaattttccaattcctattaacattcattctctcatcaaaccctcacaacatccctgtgaggtaggtcaggcaataagtggtttgcccacagccacaccagtgatagggacggagtaaacccatactgcaggtttcccagcccccaagctgatgcacctttcatttcatgttacacaggatctttgtgccaaccag

SEQ ID NO: 407 - DNA, 482 bp, Homo sapiens
  Genbank Accession No. AA482559
ctccttccaaaatacttttatttaaaaaaattacaaacaatccaaaaaaaaaaaaaaaagccaccacaaactctgcctttcttttaaataacccggcatggagcagtttggtttccaccctattgcacgtggtccggcctggttatgaaatcaggaggctgctgagactggggtcctgccgaggaagtggggttcagcctggagggaggacaccagcccctcccaccccctcaaggtgcaagaggcagagctgtggtttctatagcaacctggcagcacatccctgtcatccttcgacaggcccagctttctttatcttccctgaggccccagtggtcacaggggagtgggaactagcaggaaaggtggaagaaatgtgtaagtggaaaatcagactcccagaaacagagtctcgttaaggcatttggaatagataaattaattcaggaagacccaccttcacagaaggtcggggtaaccag

SEQ ID NO: 408 - DNA, 439 bp, Homo sapiens
  Genbank Accession No. AA485243
tttttttttcaaaagaactttattaagaaacacagaaaagatacaaaatccataaccaaaggaactgaagagtttacagcacactgggtttagcccatggcaatgtagagaaatgggctgggctggcgctcagtcactaggcaccgacgtcctgattcctcgtctttgacccagtgtcccttggttgctaagtcaaccagttctaactttctctggagacaagtcaggctgccctcccaaacctccttcctaatgtctttatacacaggccctcttccatctggtccctaagatttctcacccagcacctcaggtgagatctagtctgatgttgctgtactttgtatactgctccaatcacaggagtctgcagtttctagaaaatctatttttgctcctgtcctgatccatttcataaactgcattcacaatccagttg

SEQ ID NO: 409 - DNA, 612 bp, Homo sapiens
  Genbank Accession No. AA485965
tttttgaaatcaaatagtagatttattggctgtctctgtaatacaatgtggtgaaaacatcttaattcaggacatcttccaccttgttttggcttccagttgtactgcaagaccagtgtcaggcacataggctgattaatcagtggacaacagaagcaaactgctgctgggttacatgtctacgtgatccattccacagttttaggaattttttttctttcatagcatcttcctcttttcaaattccttgtagatcgtggttcccagctgtgcaggagacatactgaccacaactcctgcactctgaagggcagagatcttctctttagctccaccttttcctccagcaataattgccccggcatgacccattcttctcccaggaggagcagttaaaccagcaatgaaggacactacaggcttggaatttggacctgaattatgttgcttcaaaaattctgcagcattctcttctgcattaccaccaatttcaccaatcaatatgatggcctctgtggcagaatcgttcaaaaagatttcgaggcagtcaataaaatctgttccattaaaaggatcacctccaatgccaacgcacaaagactgccccaatcc

SEQ ID NO: 410 - DNA, 230 bp, Homo sapiens
  Genbank Accession No. AA486072
ttttatggttgcattgagaactttaatggtaagccgatttttcatgtttgccagtaagctcctgtgaggggttgagacggcggaacgttaagagtgcagcgttcctcccctccttgcctctagaggatactgacttccttcctggtcacagagccctggcaaagcaaggcaaagccagagctcagaacctagagacttccttttgacaaagcagcgcctcagaagctctt

SEQ ID NO: 411 - DNA, 208 bp, Homo sapiens
  Genbank Accession No. AA488072
ttttatttttttttttttttagagtttgattgcctttattatgaatataaaatgtacatacaatacaatatacatttatacatttacagtttgcatttcctttcatcttttttgagcaaattcaattctgcatgtcccagtttgccgctccttccactgatttgcacttacactcatgacgttctcttcacttgggtactctgtgtac

SEQ ID NO: 412 - DNA, 469 bp, Homo sapiens
  Genbank Accession No. AA488432
ctgacatacggataaacttttattgacataccaaagagaaaccaatattcactgaaggctgccgaatccgtatttctaagagtaaaggtgtttaattgactctccacacttaaagcactttgtatgaaatatagctacaaatatacataaagaattcagatcacaaaactctctaggacattggctgggcgcggtggcccaagcctggtaatcccagcactttgggaggctgaggcaggcggatcacaaggtcaggagatcaagaccatcctggctaacacggtcaaaccccgtctctactaaaaatacaaaaaattagccggatgtggtggcgggcgctagtagtcccagctactcgggaggctgaggcaggagaatggcgtgaacctgggaggcagagcttgcagtgagccgagaccgcgccactgcactccagcctgggcaacagagcaagattctgtctcaaaaa

SEQ ID NO: 413 - DNA, 491 bp, Homo sapiens
  Genbank Accession No. AA488658
gatcttcttccccttcttttcttccccttccccttcttttcaatttctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggggcatgagtgggtcttggtcttcttcctcttcttggtcctttttaattctgtccacgtcaagagccaagccaaggtactgttcctccaatgagtaaacagcactgctgtagggctggcctaagtcaggcagttcaagataacctgaaggaatcgaataacatctatccagtgagtcctgcaagacttcaggctctttctcatccagcagctccctgctgagcctggggcatgatgggtcttggtcttcttccacttcttggtactttt

SEQ ID NO: 414 - DNA, 235 bp, Homo sapiens
  Genbank Accession No. AA488849
  unsure (1)..(235): n = a or c or g or t
tttttttttttttttttttttttttttttttttctgtcgccacagcagcggacacgtttaatggcaggcgcctctacagttacaagacatgcctgaggtcagttcgcccccttagggagcntccccgagctaaacacagatgacagcgacccagggtgctggaggcccggggtcacctgaggactgcagaagtcctgcgctccgctaactgtgtggacacgcggctgccagggga

SEQ ID NO: 415 - DNA, 399 bp, Homo sapiens
  Genbank Accession No. AA489637
aaataaaaagtaatcatttttatttgcattggcatttttgtcaattcagactgagaaatgatgagccttttttgttgttgtttttagtagcttacatggtgcttttagttctataaaactcccatctttgttgaatgacgagattgtaaaccagaaaccaaaaaccaaaaaacacccacacagctgtcttatacttctgtaaccatttctgaacttaaaactctcttgttcgttacacctcattcattgcatcttagttttagcttgtcaaagatcttttagtagctctaacatagcccactagctaagtcttgtaaatgtgtataagctggacatttggtaatattatttttaaaaaaggaaaaggaggaataggtatacttatttaatacttattgt

SEQ ID NO: 416 - DNA, 381 bp, Homo sapiens
  Genbank Accession No. AA490120
ggttgcagtgagccaacatcgtgccactgcactccagcttggcaacagagtgagactccgtctcagaaaaaaaaaaaaaaaaaagaggacattagtttcattaggtgtgctgatggtattacagttaagtaaaaaaaaaaaaaagttcctatttttaaagcagcacactgggaggtgtagggaagaaaggacatgaagtctggcatgtccttcaaaatattcagcaaagaaaaaagggagaggaggtaaaacaactgtggaaaactcttggtaactactaagtctggaggatgggtatatgggacccatggtactcgtctcatgtctggttgaaaatatttatgatgaatttggtaacaaattcattaactattaaaatat

SEQ ID NO: 417 - DNA, 231 bp, Homo sapiens
  Genbank Accession No. AA490341
ttttttttttttttttttttttaggaaagacccttttattggggtggacacggagcacgcactagtccatgataaaaataaaatgactcaagagaaagatcgcaagggccgacttctccccaacgtgcgtgcacgctgagtgaggtctgggcatgggaaagttccgggcgacggtgggacaagaccgagtctcaatggcctggatcggtgttgggggggagaaggccactc

SEQ ID NO: 418 - DNA, 237 bp, Homo sapiens
  Genbank Accession No. AA490520
tttttttttttttttttcgaaagtacaacgctttattgaatcttaataaattgcaatttttttcttggctgttcaaagtaatgtgtttttcatttttcaaaagacactatggatgtctactttgcacgctgcgattgggagagctgtcccgctgcatgcgttccctctgtaatttcctcagagctcacatacgtacctctctcacgagtgaactcacattttccattgttttgcttt

SEQ ID NO: 419 - DNA, 505 bp, Homo sapiens
  Genbank Accession No. AA490667
ttttttttgggagtgctaactggattttttatttttatatcaagacactgtgtttaaaatttttacaaaggacaaactccatgggtttccgttagtgttttaagaacttttctttaaaaaaaaaaaaaaaccaacaacaacaaaaaacaccgcctttttgaaagagaaatgacagacacaaaagactgtaaagaaaatggggcgaatttctgatagcatttccccaagggcagaggcaaaacccagatcagacctgggggcccaatagtgatgtggcttccatagtacgttgttcaccaaatctaaggtcacctggtctggccaggccaatgctgttggcctttggggaagcaggtcaccctgcaggctctgcagccctccacacggacacagagagagttggagatctctcccctacgaccctccagctccatccagtgctagcccctttctccttccaccccatggtcttgcttaaatctgtttccttcctgggggtcttgtt

SEQ ID NO: 420 - DNA, 439 bp, Homo sapiens
  Genbank Accession No. AA490999
tttttttttgtttgtttgttttaaagagcctctttatttaatggctcagagtggctagaaaatccgtggtattggttagctttcatctcaagtgcagggacaaggcaaatccagagagaggagttgaaaggacaaagaaaaaagaaaaaaaattgctttttacgtgcattttgctgcttgacgtcactcaataaacatgcgttaaatgcataaatatatcatgaggtaaaaatcgggggaaaggtgatgcattgatgctgatagaggacaggcaaactgcattccatttggaccgcagcctctcatccccccgcccgccacacaaactaaggtcaaaatcagggagggagtccagggtaaagttatcagtagagtcagctctaggagctatagttaatctattttaaaaaatcttaaaaaacccataagtccattatag

SEQ ID NO: 421 - DNA, 407 bp, Homo sapiens
  Genbank Accession No. AA495865
taatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaactcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcaaaaaaaaaa

SEQ ID NO: 422 - DNA, 520 bp, Homo sapiens
  Genbank Accession No. AA496247
ttttttaatcaacaactttaatgtaagagcaagagtgagtaatggaaatccagctctggtagtagagagcatctacttgtggcagccaaagatttctttgcagtaacttttagctaggtttagggataaaaagaagaatgagatgaacacattacaatatgatgtaaaccactggtatggttttcacaaaagtggaaaagatttaatcagtgaataaatgctacaaatttgccaatcgatttttaacttcccctaaatttatatttcgataagcaatctctaagatttcaactctacaatatttgatgcacaaaaacacagaaaaatgttttaagggaagaataaattattttaagttagtcagactgttaagatatatttaaaaacctgtattccagaacaaaagtcacagatgactaacagaaaaaaaagaacgcacctatatctgggtaaacaaagctatgtaatacacaattacaataaattattatggtataactttggatactgttatatattt

SEQ ID NO: 423 - DNA, 650 bp, Homo sapiens
  Genbank Accession No. AA504255
tttttttttttttttgctgagaacgtaaatttatgttgtactttagaattgaacagatacaaccacagattcataccaaatgcattacttttagattattaacatattcttttacataatttcatttcacatatatggagtccaaccaagatacatctggcatagtaagttttcatcagtagcttcttgtataaggtaatgcacatgtccttcaatagataacggcagtcctgtcactctatttcgagtcttgattacaccttgtagtcgctgctcaatgtcaagaacatgggtcttggcttaatgaggtccactaaagagagagttcatcaggatccttgtgaggctatttctcatatccagaaaatcagatcaagggaagtaccctttgaagcacaaacttcacgttacttaaatgaatttgaagaacttgccatcttttcattgacaacttctccagtttcattcagtggcgctttggaatgccctttcactggtttactccattccacaagaggatcatgtagaaaagtctttaagacactcattaaaggctctcgctgatcacgcatcagcctcattgtaacttcacatgctcttcggaaaagaccctctgttcccataggacccattccattaatcatattttg

SEQ ID NO: 424 - DNA, 406 bp, Homo sapiens
  Genbank Accession No. AA504805
ttttttttttttttactattaaaaatgtattttccaaaagcaaggtagttgctgtcccaaaaagccgaaagcctctagtccctgcggaacgggctggatggggcttcagtctgacacagccaggcggggcagccctcggcgagctacggattctctgggagatttgatagagctccatcgttgccctcgcatcttccaccgagctgtgtccaagcaggctgttctggatgctcttgtgcaggaggcgctcactcagcacccgcaggagacacgcctgcagtggtccagcttggcctcacgccacaacagcctgtcagtggacgtgtcgtagattgtgtagccgctcatgtcctctttcagtgcctggaagtcgtgcttcaggtcatgacccaccaccagcttgcct

SEQ ID NO: 425 - DNA, 351 bp, Homo sapiens
  Genbank Accession No. AA505022
caggttcaagttgaacagctcctctttaatcaaagggagaacacagatgtatcaaacagagtaggaaagaaatgtatcaaaagacagtaggaaagaaagcctttccttcttgaaaggctgaggttgagagggaaagctaatttatcactacaactctatggtagctttccatgctaaattttccctgcctcttttgtgattttttgatatggaagagtaggggttatatcttctctgtaacaattaggccatatttccttataccaagtagaggtgctcaaacactgtagtggtattaaagggctgaggagagtaactgaagactggcatacagaactccacctggaggac

SEQ ID NO: 426 - DNA, 423 bp, Homo sapiens
  Genbank Accession No. AA505136
tttttttttgtattgcaaaatgtacagcatttattcacatacagacaaaaaggcacaattctactaaatagttcaacaaaaaaatacagctgtcctcaactagttttataaatactttcaaaaagggggtagaaataaatacaggattgggtcatgtaatataaaatagtcatctctacatatactttgatttttaactcttcatgcacctttttttttttcaattttagctgaatggacaccaagctaggcacatagtgaaaaatcctctgtacaaggttacaaatgtaatgacaagtttgtccatttcaaaataagatttgtacacaacacataaaacccttcatttagatcttgtgtttataacctaacaaatgacattccaggcaactttacaaaagtttaactagcctacattttgac

SEQ ID NO: 427 - DNA, 395 bp, Homo sapiens
  Genbank Accession No. AA598695
atttcaacttttattaaaccaaatccagtaacttttacaatgccttactagagggttgcctcataactgaaccttcatttctggcagggaagaaaccatggcttcaggatcatgactgaagtttggccatgttccatcattaatgttccaacatcaccagggacacaaagctcagcatgagggcttctacccaaatctccctacgacaggtacttcttcaactcttccaccacctcttgaggctcagggaatttgagtttgcgtgggggccccttcttaatcccagtccagagctccgcactgctgccgtccgggcgcacagcgtcacctcgaagctgcccctccgcgttaacgtcgggttcacctttactggaagctctggggcctccagggca

SEQ ID NO: 428 - DNA, 369 bp, Homo sapiens
  Genbank Accession No. AA598939
tttttttttttttttaattagattgcattttatttagataaatgaaaatttgccccaaacagaactaggaatcaaatattgtcttggactagaggtaattgctaagctggaagcttatattgaaaactaaaatttccagcccttgactatctgtagttccaaacatcaaaggaaaatattggaacaatttatctatgtacagagagaggcaactcatgggtaccataagcaaaataacctgagggggaacatttgatattacaagaagtggtgagagtttacaagtcttgcattgctttctattgtacatggctctgtagtaatgccaaaaataacaaaatgtaggcacttgctctggacttctgcagt

SEQ ID NO: 429 - DNA, 408 bp, Homo sapiens
  Genbank Accession No. AA598982
ttcattttgcaaatttaatgtaactctgataccaaaatatgacagcacacagaaagcaaacaataaagcaggaacagcaaacagatttttccatcacatgacaccctcagctgattggccataactgccttgactgctgtgtggacaaagattccaaggatgtactttggctccatgggaaggactactgcaatttattagcggtatctgtaaacatggggaataaatctgaaacctcactagccatacgagaagccacaggcaccaagactggcggctccactgccaaagccagcactggtgctcggtccaccaccaaagccagcaccagtgtttggtccaccgccgaagccagctcctgtgctcggtccaccgctgaagccactggtgcttggtccactgcagaag

SEQ ID NO: 430 - DNA, 346 bp, Homo sapiens
  Genbank Accession No. AA598991
catcacgacttcaggtttattagtgatatgcgcgaagtcttcctacgggtagctgcatgcaacacacggcactcctcgaatacagtcatcctaaagctttagttactgcgtggtaaggcttcttaagtcacagtgtattcttcaaggcctgggccaaaaaaagagacttcgagacaagatgacgtcagattacatggatcgctaatgaaccgagctggactagatccgacttgatctacacacatgccactactgctcagggccactgcgccacgctggccaaggggtctgcactcacggctggctgctttaggtgcggccaaggtcgcgttttctagagtgggtt

SEQ ID NO: 431 - DNA, 428 bp, Homo sapiens
  Genbank Accession No. AA599120
aaaccaaaaaacattttttcattaaaaaaagtatttagaacacacaaaacaaggcaacacttattcttttttctcatcttctggtatgggatctgttggtggctcctccactgttgcactgttgctctccgagccagtgttactatcactggttccttcctctgccatactgtcgaccccctcctgcccactctccttgtcctcaggagtagacgtgccttcttcaccattctgttggctctctgttgtttcttcaaggtgtgtctcctctgtctccatcggaatgttctcgtcgtctttcttctcctcgcctttgttagctgcttgttcttcctcaggaacgatgctgctctgactgcgctcagcttgctctgcggcctccttctccctttcctcctgccttttgcgggcctgttcctctgcctgtg

SEQ ID NO: 432 - DNA, 546 bp, Homo sapiens
  Genbank Accession No. AA599216
tttttttttttttagaaacctagagaaaaaaattttatttaaagacacattttaagtaaaatgaagaacattttacttatttttatgtccagtacagtcaaagcagccacattgcataaccccgggggacccccttcctctttgtgatgccccagaacaatattgatttgattatagaaagccaccggcagcctacatgcgcaacggtgagttgttggttatatacactgtggaccatacagtggaatattacagtcaataaaaggtatttttagagagaaaaaaaaacattggaacacgcttatgatataatgttaggcaaaatcgctgttatgaacagctcgtttggggcagagcaaatcctgggaagtaacgctgaggctgttggtgcaggcagtggagtacaacatcttcgagggtatggagtgccacggctccccactagtggtcatcagccagggcaagatcgtctttgaagacggaaacatcaacgtcaacaagggcatgggccgcttcattccgcggaaaggcgttccggagcacctg

SEQ ID NO: 433 - DNA, 324 bp, Homo sapiens
  Genbank Accession No. AA599331
gactgtgaggaatttttattttcctttcatgttcactaattgcaagctttcttcatttcggtaatatctaaaatgatctcctcttgtcggaggtagattttcccagtagcttctaactcctgacccagaagcggtgtattgcgcctcagcatggaggaggacgtgaaggcgtacggagtctgggagtagtacaccacgtaggtaggtttgtactggtttggctttgtgtactgtgttccccaggcaattcgaatccagactgcattctcctcagtttctctgaagctgactgtcacattttttaatgctctctgaagaattttc

SEQ ID NO: 434 - DNA, 271 bp, Homo sapiens
  Genbank Accession No. AA599365
tcacatgatagttttaatatttatttagcagaggggtaaattgaaacatcagttctctagaccagtcaggaaatgtatgctttgtgctttataagcttacattcaacatagatgacataagttaccatactcaaatgtaagatagggagaggtagaagaaatagctgagaacttgaaaagatgtactgttattgtcaacaaaccaatgtcttctcccttcataaaattgtgtttagggaatattaacaattaagcttgtatacaatagtaa

SEQ ID NO: 435 - DNA, 409 bp, Homo sapiens
  Genbank Accession No. AA599376
tctccagtgaatgaatttatttttatgctggaaatccttgccttgaagtgaagacagtttcaagcctttctaagcagttactgtctgttcacacaaatacaatgccagctgagtgtgcttcgccgagacagcaccagggattccagcacagggaattgaaaacagacacctgcaattcatttccctgcacagcctagaccaaactatgctgtgatgagcattcccagggcagtgtttggactggtgtgtgggtggcatattcctgcagaatataagattaggttatcttataatagacataataacagaagattcattcaaccagcaaatatttattaaatgtctactttgtgctaggtactcttctaggtactagggatatcacagtgaacttaagtctaaaaattcc

SEQ ID NO: 436 - DNA, 365 bp, Homo sapiens
  Genbank Accession No. AA599443
ctgtaatagtcagcatgacctctattttattgattgattgatggattgattgagacagagtttcactcttgttgcctaagctggagtgcaatggcacggtttcagctcactgcaacctcggtctcccaggttcaagcgattctcctgcctcacactcccaagcagctgggattacaggtacccgccaccatgccaagctaatttttgtatttttagtagagacggggtttcaccatgttggtcaggctggtctcaaactcctgacctcaggtgactgcccaccttggcctcccaaagtgctgggattataggtgtgagcaccacacccgaccagcatgacctttaaacacaattggacttaagac

SEQ ID NO: 437 - DNA, 317 bp, Homo sapiens
  Genbank Accession No. AA599522
ttttttttttttttttttttttttttttttttttttttttaaaaaataaggagggagctttatttaatatgaaggttgaggcagggccggggcgggagggcgctgtcacttggtgatggtgttcgcgttcatgctcttgccgctgccgctgagcacgatgtagggggtcttctgagccttctgcttctcctggagcagggccacggtgcccaggggcgtgtcgctggagctcatcttcttcaggagcgcctcctcgtccagcttcttcatccgccgctctgtcttcatcttgcctgagcccttgccatggaagcggt

SEQ ID NO: 438 - DNA, 226 bp, Homo sapiens
  Genbank Accession No. AA599661
gaaccatttttctgttctcttatttattgacagtttcttttaattacaacacaatgaattgatggtaaatacagaagatgcaatagtataaaaagccatttaacccttccctaggttaagacacttacagcagacaaaaactgccccacccctaatcccctccttgaatggaaacaaaataaatataaattaataaatacaaaacaaatcactgcacagcccttaa

SEQ ID NO: 439 - DNA, 273 bp, Homo sapiens
  Genbank Accession No. AA599662
tttactctaagaatttgtcttatttttaatgcatggaaaatagcaaaattatcatgccaacatgaggaatatatactataattcataaatgcctaattatcaaaataatgacatagtcatggttagatgcaacctagaaatcttatataagatgcaactacatattgtatgatcattcctcttatatatgacattcaatcctcatcaaattcagctatgaataaatggcattatgaaataaacacttaatatcacaatagggtcatagtctgc

SEQ ID NO: 440 - DNA, 281 bp, Homo sapiens
  Genbank Accession No. AA609006
tttttttttttttggcctgtatctcataattatttttatttagaggaatttggtagtggcggggttggggtgggaggtggtgtgtggacggtgtgaattgacagaaacaatttccctacaccaaaatacaggtatgttttcattctctatgcccctaaacaccctccctgcagctatgcaacgagcaattcacgggaagaggcttctttacatagacccctgtttttggtgttttgatttacttttgtgtatagagttgatctgtccctcttcccattggt

SEQ ID NO: 441 - DNA, 467 bp, Homo sapiens
  Genbank Accession No. AA609027
ttttgaacatgtagctcactttattttccccaaagatgtcttgaaattttaatcagttcagtcatccctatctttcttcttacatattaatcctatagattagtgactcttgtataagacaagaaaaactaatgtgcttgtttgatatcagcacagatcagtctctaagcagaagtgaaaatatgggaaaatgagttggaaaggaaaatgttatagaaaatagtaaagacaaaccatgggaccaccttttctcagtgagagatacattgtcgggggcagagtgctggagagctgggcagagaggaacaaaatgtctgacagcaggagccggagcccagggaggaaaccagatggaaagggctctgctcagactgactcaatgtgggcacatatgggataaaggacatcacagagaactcaggaacagaaaccacactgaaatagagggatggggagacatgctgggc

SEQ ID NO: 442 - DNA, 399 bp, Homo sapiens
  Genbank Accession No. AA609309
tttcctcactgatagctgatcacattaaacaggtacaggtgctaagaaagtttaagactgatattttggcaatgacagtttaggttaactctgtttggaattcctaaaaataaaaagaaatcccttaaaaaaggctgacaaactgaccacttggccttgaatcgactgttagggtcacacctgccaatgccaggggacatcacaaaaaaatagagaatgccaagataaaaagttcactgcattcaatttggcctaatttcttgataatagtttcctattagattttccgattaatactgatggctcttacctaggctgtgataattaggttttgatctattgtgacattaatgatcacaatcagttgactttgaaattgtcttaattaatggctctttc

SEQ ID NO: 443 - DNA, 387 bp, Homo sapiens
  Genbank Accession No. AA609312
ttttgggtttgtttcttttaatcacaagaagtctctctgtgggtgctgagctcaccgtgccgcaacgtcatggttatgggtggctggtccccagtcagtctcgtgtggcagtcgggaccttctacttccttgccttcgctttctttcctttgctcgctctttggggcttcagggcttcctcctggcctgcgtggctggtgatggggggcgggataggggtgggggcgttgaggttcagagtcttcttctgaagcttcaggtccaagatggcgaatgtgttctggatctggcgctgcagcagctcctgcaggagctccatctgggtgtggactgcctggcagatgaggctctccaactcctgtctctccaggacctggccgggctgcg

SEQ ID NO: 444 - DNA, 353 bp, Homo sapiens
  Genbank Accession No. AA609504
gttgttttttttttcttttaaaataagactttactgaatatatcaacaaggtactgtatagtgtagagtgaagtttgtcattaacaaagtgtgcgacatggtaggtctcagaggatgtgtgatgcagaatctttcagccccttatcagagagaacacactaaacagaaaccagaagcaaatcagcatatggttcaaacaataacaaatcatcaggttaactttcagtgaatatacactagtcctatgagcgacacacacttggcaatgccttcaccttgccttaaacattataaatcttacattccagggacacctttacaaatgcccctgtttgtgtgtgtgtgtgtgtgtg

SEQ ID NO: 445 - DNA, 424 bp, Homo sapiens
  Genbank Accession No. AA609645
tttttattgttacagaaccattaaatacaacttatacacaagcaagctgggcggcgtccggggggcagggagagtgcaagagggtcaggggtgagcagtccgggcccggtcctggagggggctgaggctgccgtcgtgggaggggcttggctggcggaggcgggctgcctgtggaggccttgaagctttgccagcagctcctggatgaagtcctcgacaggtttcccacatgacttcaggagtccctggattttccggcttctctcctcttcactctctaactccaacaattcatcaatgttgatctcatcgggcatgtctgcctccatgccgcggtacagctcctccaggcgcccgtcgatccacttctccacgtccagccgccgctgcagctcccgccggtcatacttgacggtgacgcgcg

SEQ ID NO: 446 - DNA, 417 bp, Homo sapiens
  Genbank Accession No. AA609657
ttttttttttttgaaagctgagaaatgtttattcccagaagacagtggtgacacgatgtccagccacctgtcagccagtgatgcagggttggtggctctgaaatgttaggtctcccagcccggacacatatggctgtcttctggtgactgtttctctcaaactaaccacgcgggtccattagaagctgccatgctctcagaggagcccccgccacattctgccagcctcagctccagaggtgttgctgacctggggggatgctgcttcctgcctctgtggctttgcatgttctggatgtttcattccaatggagtcatacggcatgtggtcttttgttcaaatccagttttagggcagtcctggagcagcactcaccactcagtccgaggtggcttccctctgtgataaggtcccct

SEQ ID NO: 447 - DNA, 156 bp, Homo sapiens
  Genbank Accession No. AA609848
ttttttttttttcattcaaggagcatttattgatcgtctagtatgaaccagccccagtcaccaggcattgaggaaatcattggtaagtaaaagaggcaagttacctctcaacacagattttgtttttaaacctcacagtcttgcaggtgtcattgt

SEQ ID NO: 448 - DNA, 370 bp, Homo sapiens
  Genbank Accession No. AA609869
ttttcatacgattggtttaattttttttttcagcaggagaaaaaagaataaagttacaagattcttttaatattttcacaatgttaaaactaaaactgagctctaggctatgtgtgtaagtaaatctagaacacaaaagggttaaataagattttctcttttaaagatacaagaatttaagctttccttacatttaacaaacttcacagaacagatactgcaggggaacaagccccaccccccaccacccccagctctaagtcaggaagcgaacatgggcttcgctcccccaggccagctcccctgggctccttcccatggctgcctccacgcagcaggcagaggagggggcggggggcctggggagggc

SEQ ID NO: 449 - DNA, 377 bp, Homo sapiens
  Genbank Accession No. AA609943
ttttttttaaatttaacactttcaaactttattatcagtacagtcaaagcaatacaaagttatatggaactaaattaatctagaaagtagatttttatatcattcaagataaggagaagcccagattaaatatataaaattgttgttatttacacagctaacttcccgctttgaaaacaatcccatacgtaaatttcttttttggagcaaggtaacttggtgattgttctatctctacccagaattcacccctatttggaaaactgggggctaaaagcaatcagaattcaccagttcaaaaacacttacgtccatcttattagcaacactaactacccagaggaaactaaaatagaccagatttacagcagtaagta

SEQ ID NO: 450 - DNA, 365 bp, Homo sapiens
  Genbank Accession No. AA610070
tttattgaacacataaaaggaagtatatttaaaaaaaattggtcaaactgtcctgttagttatcattttaaaggaatttacagggctgttatagatgattcttttggaatatttcagtttatagcaaatgcctaaactggtttcttcattgcacagtattttctcttaaaatgggtgctttaaaacaattacatacagattaaaaatcatttctttgcttaattaaaacgttaatactcttagacaacacagatctgaaatggtgaaaccagcaattccccccaccccaccttacaacaaattaaattgagacaaaattacaaacacatttcactacatgattattattaataaaaatcagtttc

SEQ ID NO: 451 - DNA, 487 bp, Homo sapiens
  Genbank Accession No. AA620289
tttttttttttttttgttaagacaggaaacacatttattgagagcacagtggggtgcgccaagccctgtgctttggaaccgcatcacagcgcccctcacaacagccctgtgaggtaggtgaaggagcccacttcccacatgcagacactgaaggctcaacagctcccctaggcctcagggttcctgcggggtgggcaggggtccagcccacgggtctgaccccaggtcagcggcgtccatcagtcagagggcgggtctctactcaaggggaggccccgggtccagagtctctgggtccagcctgtcccgtgggaataggtgcagggtgtccccgtggctgtggagggatttcgagctggagaggggctggggtccacattcgaggtcccttcccacgtaggcatccaggtgatggcttccgccaaaccaggaaggagacgagaggcccgccaggaagaagacttgggtccgggatggtgggcccatc

SEQ ID NO: 452 - DNA, 303 bp, Homo sapiens
  Genbank Accession No. AA620461
aatgttgcataacaatgtttatttagttttacatttgtttacaatttcttataaacacttcattataattgttttatacaaacaacagtttaaatttacttatgtttatcatttatttgcttactagtttttcaatttcagataatccttttagaatcatttcccttcttgaagatcatccttttgtagtctctttactgaagttgtgctgaggataacatctgtttttcatctgagcatctgtttgtttcagtttcgcttgttgcaaattctaagctaatagtttttctcagaattctaccc

SEQ ID NO: 453 - DNA, 411 bp, Homo sapiens
  Genbank Accession No. AA620806
tttttttacagagaaggctagttgtaaacataaacattctcactgaactactggccccccaaaacctaacctatctcacaatcaataatcatcttttgactataaaatcataaaaacttgtactctgtggctcttttgtctcgatgatttttcagagaaaaaaattagctgtgttaagtagtttcactgatttatccatcttgaatagctgccagttctggaacttcatacatcctcagaacgtcttcatagagcaaataattatgtaggcttctgggaagtggcagctgactaatataactgtcagaccgtagacgttctgattttagactggaccgaatttccaaacgacaaagatgggtcagggatggaacagtggcaatatgttgctgtagaatccaagcgtttgag

SEQ ID NO: 454 - DNA, 277 bp, Homo sapiens
  Genbank Accession No. AA620825
caaaaagacttatttacaagttgagcatgtcatctcaattcatagcatgtagaaaaagctaaaaatgttttggagatataaatttggctggacgactcacctacagtatattcagggatgtcttctgtacagaatatatacaggttgggactggcaagggaaatcctatctcaggaaggcgatgaacaccaccacagagccacagacccttagcaatgttccctggctttcatttgcagttggccttgtctctggacagagtttgatgtgctgggac

SEQ ID NO: 455 - DNA, 431 bp, Homo sapiens
  Genbank Accession No. AA621325
tttttcaggtttggcacataaattttatttaactttcacattgacacaatcaggaaaccattctgagaaaaggtagaggccgccttgaagcgaacgctggctccctcctccaccccgggctcggcggcaccatgcaggctcaggctggcactcatcccaggaaactgtcccagttctcagcggtcctggctgtggacggtatctgaaatggtcgctgcggcttgccctgcaccagggcctaccttgttgccaggaagccgcactgctggaggctacctgggcgctgggttttattgctggtgaacttggttacccaccttccagtcacatggtccaggatggtggtgtgatcagaaatggctctggcagtgccattttgctgagatgaaaggaatcgaaatgtataaactacactgaattctgtgatgctg

SEQ ID NO: 456 - DNA, 464 bp, Homo sapiens
  Genbank Accession No. AA621367
tttctagttcttgactttaatgcccttggagtgtactgaggctcaatacaccaaagcactcacagacaggtacatgaactcacacaggaagtgttatagtgtgtacataaacccaacaccatacagaaggaagacgacggacccaggtgacaaaacttctcgggacttcctggtcaagccctagctatcagcctcaaggaaagactaccatgccttgaggaaaggccaggtgagcgctggctggagtgcctgcaggccgcaagccctgagcccaaccctgaggtgcagtcagggagattggagctacacctctgtcccctgggagctgtgcctcaggatgctgttctcacctcggcagattctggggcagtcagcagccccttcagggatcttactcccagagccaccaagcaaggtggacatcctccctgatgggactctcgcctaccggggctactcaccac

SEQ ID NO: 457 - DNA, 361 bp, Homo sapiens
  Genbank Accession No. AA621634
tttttgggctttgcaaaattttaatatattaaaataagaggcatctgttagaaaacattctattgtataaaacccgagttcttaaaaacatgttttctttggcactttcattccctccctcccctttccccagcatattgcaaaaagctctccagtgctaaggcattggcagggtgtgtaaacagcagccagcatatgtggaagaataatacaaagcttttttttttcttctaatatgtctgtgcagcaagcataaataacaggacccattccaaggagtgtgtgtgggttttccccctcccctgtgtcctctgtcaccttggtgatgaggccagagtgatgtgaagactgggagggaacc

SEQ ID NO: 458 - DNA, 372 bp, Homo sapiens
  Genbank Accession No. AA621695
tttttttttttttttttttttttttttttttttttagggtctacccataaagctctttattggcctccagggccctggtccagccccactgtggggtcacatggaaacccaggctggggagccgcctcttgtctcacaaaagtccacgtcctccgggaaaacggcaagccctcggcgtgggggtcagcgatgccgggccctccatgctacaacctcttgttcttgctcagccggttgtggcgccagatgttctgtttccgcagccgccgccagtactcccggctctcggggtccagctcctccagggtctttgggggaccaagttcatctcaaacagccattcagggtactcagcatccggtttcaggggta

SEQ ID NO: 459 - DNA, 1201 bp, Homo sapiens
  Genbank Accession No. AB000584
agtcccagctcagagccgcaacctgcacagccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcacaccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttc

SEQ ID NO: 460 - DNA, 6289 bp, Homo sapiens
  Genbank Accession No. AB002335
acgacctatggtctagtaggggttctgggggctggggcgtgtaccgctcccctagctttggagctggggaagggctcctgcggtcccaggctcgaacccgtgccaaaggacctggaggcacctctagggcattgagggatggaggatttgagcctgaaagagtcgacagcggaagtccctgtcaaatccagatatcgcctcagagaccctgacgcttctcagtttcctgcgctcagacctttcagagctgagggtccgaaaacctggtgggagctccggggaccgtggaagcaaccccctagatggcagagactcaccatccgcaggtggccctgtggggcaacttgaacccatacccatcccagccccagcatcacctggcacgcgccccacactcaaggacttgacagccactctgcggagagcaaagtcattcacctgctctgagaagcccatggcccgccgcctgccccgcaccagtgctctgaagtccagctcctccgagctcctgctcacaggccctggtgccgaggaggatccgctgcccctcatcgtccaggaccaatatgtgcaggaggcccgccaggtttttgagaagatccagcgcatgggtgcccaacaagatgatggaagcgatgccccccctggaagccctgactgggcaggggatgtgacccgagggcagcggtcccaggaggagctctcaggccctgagtccagtctgacagatgaaggcattggggcagaccctgagcctcctgttgcagcattttgcggcctgggtaccacagggatgtggcgacctctttcctcatcctcggcccagacgaaccaccatggccctgggactgaggacagtctgggcgggtgggccctggtgtcgcctgagacccctcccacaccaggtgccctccgccgacgacgcaaagtcccaccttcaggttctggtgggagcgaatttagcaatggggaggcaggggaggcctacaggtccctgagtgacccaattcctcagcgccaccgggctgccacctctgaagagcctactgggttctctgtggacagcaacctcctgggctcactgagccccaagacagggctccctgccacctcagccatggatgagggcttgaccagtggtcacagtgactggtctgtgggcagtgaagagagcaagggatatcaggaggttattcagagcatagttcaggggcctggcaccctggggcgtgtggtggacgacaggattgctggcaaagcccccaagaagaaatccctgagtgaccccagccgccgtggggagctggctgggcctggattcgagggccctggaggggagcccatccgagaagttgagcccatgctgcctccatccagcagcgagcccatccttgtagagcagcgggcagagccagaagaacctggtgccaccaggagccgggcacagtctgaaagggccctacctgaggctctgcctccccctgccactgcccaccgaaactttcaccttgaccccaagctggctgacattctgtccccgaggctaatccgccgaggctccaagaagcgcccagctcggagtagtcaccaggagcttcggagagacgagggcagtcaggaccagactggcagcctgtctcgggcccggccctcctccagacacgttcgccatgccagtgtgcccgccacatttatgcctattgtggtgcctgagccaccaacttctgttggtccccctgtggctgtgccagaacccataggcttccctacccgagcccatcccacgttgcaggcaccatcgctcgaggacgtcaccaagcagtacatgctgaacctgcactccggtgaggtccctgccccagtgccagtggacatgccctgcttgcctctggctgcaccgccctctgctgaggccaagccccctgaggcagctcggcctgcagatgagcctacccctgccagcaagtgctgcagcaagccacaggtggacatgcggaagcacgtggccatgaccctgctggacacagagcagtcgtatgtggagtcgctgcgcaccctgatgcagggctacatgcagccgctgaagcagccagagaactccgtgctctgtgacccttcactggtggacgagatcttcgaccagatccccgagctcctggagcaccacgagcaattcctggagcaggttcggcactgcatgcagacctggcatgcccagcagaaggtgggagccctgctcgtccagtcgttctccaaggatgtcctagtaaacatctattctgcctatatcgataacttcctcaatgcaaaggatgctgtgcgtgtggccaaggaggcgaggcctgcctttctcaagttcctagagcaaagcatgcgtgagaacaaggagaagcaggcgctgtctgacctcatgatcaagcctgtgcagcggatcccacgctacgagcttctggtgaaggacctcctgaagcatacacctgaggaccacccggaccatccactcctgctggaggcgcagcggaacatcaagcaggtggctgagcgcatcaacaagggtgtgcggagtgccgaggaggcggagcgccatgcccgtgtgctgcaggagatagaggctcacatcgagggcatggaggatctccaggcccctctgcggcggttcctgagacaggagatggtcattgaagtgaaggcgatcggtggcaagaaggaccggtctctcttcctgttcacggacctcatcgtctgcaccactctgaagcgaaagtcaggctccctgcggcgcagctccatgagcctgtacacggcagccagtgtcattgacacagccagcaagtacaagatgctgtggaagctgccgctggaagacgcagacatcatcaaaggggcatcccaagccaccaatcgggagaacatccagaaggccatcagccgccttgatgaggacctcaccaccctgggccaaatgagcaagctctctgagagccttggtttcccccaccagagcctggacgatgcactgcgggacctctcagctgccatgcaccgggacctgtcggagaagcaggcgctgtgctacgcgctttccttcccgccaaccaagctggagctgtgcgccactcggcccgagggcaccgactcctacatttttgagttccctcaccctgacgcccgccttggttttgaacaggccttcgatgaggccaagaggaagctggcatccagcaaaagctgtctagaccctgagttcctgaaggccatccccatcatgaaaacccgcagtggcatgcagttctcctgtgcggctcccaccctgaacagctgcccggagccctcgcctgaggtatgggtctgcaacagcgacggctacgtgggccaggtgtgcctgctgagcctgcgcgccgagccggacgtggaggcctgcatcgccgtctgttccgcccgcatcctctgcatcggggcggtgcccgggctgcagcctcgctgccaccgggagcctcctccgtcgctgaggagtcctccagagacggcaccggagcccgccgggccggagctggacgtcgaggccgctgcagacgaggaagccgcgacgctcgcggagccggggccgcagccctgccttcacatctccattgcaggctcgggcttggagatgacgccgggcctcggcgagggtgacccccgcccagagctggtgccctttgacagtgactctgacgatgagtcttcgcccagcccctcggggacgctgcagagccaggccagccggtccaccatctcctccagctttggcaatgaggagaccccgagttccaaggaggccacggcagagaccaccagctcagaggaggagcaggagccaggcttcctgccactgtctggctcctttgggcctggtggtccctgcggcaccagcccaatggatgggagagcccttcgccgctccagccacggctccttcacccggggcagccttgaggacctgctgagtgtcgaccctgaggcctaccagagctccgtgtggctgggcactgaggatggctgtgtccacgtgtaccagtcctccgacagcatccgtgaccgcaggaacagcatgaagctccagcatgcggcctctgtgacctgcatcttgtatctgaataaccaggtgtttgtgtctctggccaatggagagcttgtggtctaccaaagggaagcaggccatttctgggacccccagaacttcaaatcagtgaccttgggcacccaggggagccccatcaccaagatggtatctgtgggtgggcggctgtggtgtggctgccagaaccgagtccttgtcctgagccctgacacgctgcagctggagcacatgttttacgtgggtcaggattcaagccgctgcgtggcttgcatggtggactccagcctgggtgtgtgggtgacattgaaaggtagtgcccacgtgtgtctctaccatccagacacctttgagcagctggcagaagtagacgtcactcctcccgtgcacaggatgctggcaggctcggatgccatcatccggcagcacaaggctgcctgtctgcgaatcacagcgctgctggtgtgtgaggagctgctgtgggtgggcaccagtgctggtgtcgtcctcaccatgcccacttcgcccggtactgtcagctgcccacgggcaccactcagtcccacaggcctcggccagggacacaccggccacgtccgcttcttggctgcagtccagctgccagatggcttcaacctgctctgcccaaccccaccacctcccccagacacaggccccgagaagctgccatcactggagcaccgggactccccttggcaccgaggccccgcccctgccaggcctaaaatgctggttatcagtggaggtgatggctatgaggacttccgactcagcagtgggggcggcagcagcagtgagactgtgggtcgagacgacagcacaaaccacctcctcctgtggagggtgtgaccctgtctgccgtggcccaggactcgcccgcccacctgccttcagcctgcttgcctctccctagcccacacgcagactttgaccaggagtatccagccaggggcacacatgtgcctgcgtgggctctgccttgtcttcgcggaagcattcctgatggaacacccactggccagccaggccatggcttctcccgaccctctggctgccccggtgcttccagtcatgatcgggtgggggacatgtgggctgaccaggacctctgaccctggagcttctaccaaagacacagctgggtctggaccccacggggctggggagggccatgtgcaatatttggagggttttctggagggcagcaggaaggctggggaattccccatgtacagtatttatgtttctttttagatgtgtaccttcccaagcacttatttatgcagtgacctggtcacctggggtgggggtgatttgaggaaatgacatgaggaaaagaaacctattcctgccctggggaccaccctgggactctaaccaagccttcctggagggacccatgcgcccctgagccccattccattcatacagacacacacgtacgcacactgcatgtccaaggccctaaacattgcccgttgacataaactttccagggccccagcctgatggggctgccctcagtcctctagatcaagatgctgactattagggggcagtgattgccatctggggacctgtcaggctttgtcatttcccagtttgttggtggtgcctttagtggttccctaatttgggaacactgatggggccttggacagggctttctctcaggtaggagaaatgggcccatgatctcctcacagtcgcccccagtccttggccctgcttccctgtgtctcatgcactggcacatatggtcaccttggagggcagacctaggagcccctctgaccactgaatccgtctccacaccccttctgccaagggaagccccttcaggaaggaccccccaaagctgaggggctgaatgtagccttttcaacagagaaggctcccacttgagagcagcctctacctgaccccctggaccacagagagccactctgaccctcagccccctcgcttcttcagctaaaactccaaaggtttggtttcagatggggtttgttttgttctgtttggttttggttttgtttggggtgggtgggtcattgcggtcttagattatgtttctcttgctaccaaacagtcatgtattaactctctttggatgatgaagtttaaagagtcaataaatagaaacaccag

SEQ ID NO: 461 - DNA, 6824 bp, Homo sapiens
  Genbank Accession No. AB002340
cttgtgctaacaatttatgaagcaaaaggcttagaatttgatgatgtcctcctttacaacttttttactgattctgagggatgcccaagttggagcaagctctaaggagagccttacagatgaagccaaggttagcaatgtccaccctgtgatgacagaactgggtaaggtcagttcatagatagagacaattccaggaagacaaatgaggcttggttcctgccctctggatcaggtaatgtgggggacaagaacagcttccttgcatgagagacccctctagcatggcttcactaccactgcttgcagctcatgcagatgatggcagccaaagagtccccacattgacccccagtgacctctgtattggtccactgctttcacttggctcctgagtccttgtgggtttttctccccaagcttagttcattatgggtagagctaccaactcacagccgttgtcctgggttttctagccactgttttctctttcccactatcttttggtggagactcaagctggctgctgactgtactgtggggtcttctctggggacttagctggctgtgtcccagtccttgttgcagacttcctttgcacatgatgcatgcttgaaggggctatgttatacccaagtcaagagcactgttggctttaacactttaaaaatctgccccagaactgaccctttagatagagtccttcctttttttcttatcattttttaaatgttattttgccttaatagcacaactattacaatattgatataggtgctttgcagtttacagagtactttttgaagtcattgtctcactccaccaaccctctgaggttatatgtatttttattactctcattctattttttaaaatttatttttatttttatagagatatggtcttgctgtgttgcccaggctggtctcaaactcctggccttaagtaatcttcctgccttggcctcccgaagtgctgagattataagcatgagccacctttatctgtagataaagcagaaggtcactgagattagtacatttctcatagtcgtaatgtagatggcagagcctggagatgaactcagatgctttgagttctaaatctctttccattttccttccttttaaagcctcgcatgcgaattgaattccagaaccttccacaattagtgtatcattgctgttccttatgtacattcctttcctgttaaattttgctaataaaatcagatgcacactcattaaccctggaaccatttttacctctgaggactaacttttttttctaatgatacatccatcggtcatggttggactgaggctctcctaaaagaggaagggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaagcagagaaaatactaatgtccacacagctgcagcctcctcatccttcggaacattccattctgacttagaattctgagcgctggggcagaagacaaaaagaatgtgaattagcattttaaaaatagataggggagtctaacaacaccattgctttttattctcattacttctctttcagtggcttaggatctgattgctccctcacctctaaagtgtttccaagtagagtctggcagtattagtttcccccacaaacaaattcaggtagagaagttgtagtcgaagggaatgttgggactcctcactgcatggtccctggggtgtctggctcatccccatcatgacatgagttggtagcagaggactaggtgttaggacagactctcctcacctcagttgctgctgctctgggccaggaaatctctctatggattccctcatctcctgccacactgctgcagcatcaagtgtgctatgagagctgtatgtgcccaggggtgggccctgccactggccaccccgagcccaggacgcattctggtcatctctgagcccacttgtagtgtagcttcttctgttagagatgttagccttttctctctgtggcgacttttctgccttcccttcttctgttttttgtgatcattcttagctacctgtgccaagtcacagttagactacctcagaatgtagtcaagaattcacccagtgttctttggatgtcccttccctagggggaaaggctggggaatgttgctgggagcattcccagctgcctctccaaagtggtcctaactctgccttggctatggtgcagacattccaaaaagtgttttgtatacagccctgtacatctagttttcttggttctccctggcaagttcgctaccctagcttaggctgacgttctgatgagtctctgcttgctgagctcatcactgtgggatggtgacctgcagagctgcagattggagcaagtggacagaggagggagccagctaagccaaatccgtcactgccacttggctggcaggccttataagagggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctctt

SEQ ID NO: 462 - DNA, 5432 bp, Homo sapiens
  Genbank Accession No. AB002379
gcaagaccaaggtggctgtgctggagatcctgggtgctgtgtgcctcgtgcctggtggccacaagaaggtgctgcaggccatgctgcactaccaggtgtatgcagcagagcgaacccgcttccagaccctgctgaacgagctagaccgaagtctgggccggtaccgggatgaagtgaatctgaaaacagccatcatgtccttcatcaatgctgtcctcaatgctggagctggagaggataatctggagttccgcctacatctacggtatgaattcctgatgctgggtatacagcctgtgattgacaagctccggcaacatgaaaatgccatcctggacaaacatttagacttcttcgagatggtgcggaatgaggatgacctggagctagccaggaggtttgacatggtccacatcgacaccaagagtgcttcccagatgtttgagttgatccacaagaagctgaagtacacggaggcctacccctgcctgctctctgtgctgcaccactgcctgcagatgccctacaaacggaacggtggctacttccagcagtggcagctcctggaccgcatcctccagcagattgtcctccaggatgagcggggtgtggaccctgacctggctcccttggagaacttcaatgtcaagaacatcgtcaacatgctcatcaacgagaatgaagtgaaacagtggcgagaccaggcagagaagttccggaaagaacacatggagcttgtgagccgtctggagaggaaggagcgggaatgcgagacaaagacattggagaaggaagagatgatgcggacgctgaacaaaatgaaggacaagctggcccgggagtcccaggagctgcgccaggctcggggacaagtggcagagctggtagcccagctcagtgaactctcaacaggccctgtatcttccccaccaccccctgggggcccactcaccttgtcttcctcaatgacaaccaatgacctgcctccaccccctcctcctctgccctttgcctgttgtccccctcccccaccaccaccccttcctcccgggggacccccgactcccccaggtgccccaccttgcctcggcatgggcctgcccctccctcaggacccctaccccagcagtgacgtcccactcaggaaaaagcgtgtcccccagccttctcacccactgaagtccttcaactgggtgaagctgaatgaggagcgtgtccctggcaccgtatggaatgagattgatgacatgcaggtatttcggatcctggacctagaggattttgaaaaaatgttttcagcctaccagaggcaccaggagctgataactaatccttctcagcagaaagagctgggctccactgaagacatatacctggcttcccgcaaggtcaaagagctgtcggtcattgatggccggagggcccaaaactgcatcatccttctttccaagttgaagctttctaacgaggagatccggcaggccatcttgaagatggatgagcaggaggaccttgctaaggacatgctggagcagctcctcaagttcatcccagagaagagtgacattgacctcctggaggagcacaagcatgaaattgagcggatggcccgtgctgaccgcttcctctatgaaatgagcaggattgaccactaccagcagcgactgcaagccctcttcttcaagaagaaattccaggagcggctggctgaggcaaagcccaaagtggaagccatcctgttggcctcccgggagctggtccgcagcaagcgtcttagacagatgctagaggtcatcctagccataggcaacttcatgaacaaagggcagcgtgggggcgcctacgggttccgggtggccagcctcaacaagatcgctgacaccaagtccagcatcgacagaaacatctctctgctccattacctgatcatgatcctggagaagcattttcctgatattctaaacatgccttcagagctgcaacatcttccagaagccgccaaagtcaacctagcagaactggagaaggaggtgggcaacctcaggaggggcctgagagcggtggaggtggagctggagtatcagaggcgccaggtacgggagcccagtgacaagtttgtccctgtcatgagcgacttcatcacggtgtccagcttcagcttctccgagctggaggaccagctaaatgaggccagggacaagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatgctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcggtgggggagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaataaagtgtttagggcagtgggaggagaaaattctccaggtgaatggggaagggtctgttccagcctctccctactcccatcccatttccaccaactggggaactgtgactatctatctcccccgacttctaccagggatgccttcaagccaaggctgttctcaccagctgcctcagatgacaaatgaggctaatggacataatctacagtgtcctttttcacttgcaccttttttataagaatatattgtaatactaaaaaatattaaattcataccatccctaccc

SEQ ID NO: 463 - DNA, 760 bp, Homo sapiens
  Genbank Accession No. AF001294
agagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggcca

SEQ ID NO: 464 - DNA, 3111 bp, Homo sapiens
  Genbank Accession No. AF010193
ggcacgagcggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggtcagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgttttttcctatgggtgttatcacctagctgaatgtttttctaaaggagtttatgttccattaaacgatttttaaaatgtacacttgaaaaaaaaaaaaaaaaa

SEQ ID NO: 465 - DNA, 1601 bp, Homo sapiens
  Genbank Accession No. AF141349
ttcctgccgttgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggg

SEQ ID NO: 466 - DNA, 330 bp, Homo sapiens
  Genbank Accession No. C02016
  unsure (1)..(330): n = a or c or g or t
gatcctcactcaacgaaaactcggttggaaactgttccgcctggcagtccttttttnttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaancttgaaaattacancaacagtctacgtcacagccaaattatatttcctttataccaaacanaactatggagaactaaaagtacancacacanaacgttnatagtgttttgcatgtgacct

SEQ ID NO: 467 - DNA, 325 bp, Homo sapiens
  Genbank Accession No. C14898
gcatgacatatatagattaactgtgactaaactttacttccgtaacagtaaatattacttaacccattcctgaaatataaagctcatacacaggtcagggaaaaagtattctaagtatctgamtggagaaamatctagagtgactattttagatgactgtagagggcagcaaagcaacagtagtatcctcaaagaaaaacatgtatttbtcttagggaacttcaaatttgttttatatttcaagagatgctgtcaggattaaagcttttgaaggaaaaggggctttggggcatgccaaatacaaatttcaccagctacttatata

SEQ ID NO: 468 - DNA, 287 bp, Homo sapiens
  Genbank Accession No. C15965
gtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggactgtgcactaaagtgggggctttaactgtagtatttggcagagttgccttctacctgccagttcaaaagttcaacctgttttcatatagaatatatatactaaaa

SEQ ID NO: 469 - DNA, 146 bp, Homo sapiens
  Genbank Accession No. C20547
  unsure (1)..(146): n = a or c or g or t
gatcaaaaatatgtgaccttaatgagatttttatgatttctaaagtaacaataaaagcagtttttagagttgagttccagagagggcagggcaatggcagtnacatgtttgtcattttaataataaataacatctattgagtnctt

SEQ ID NO: 470 - DNA, 394 bp, Homo sapiens
  Genbank Accession No. C20658
  unsure (1)..(394): n = a or c or g or t
gatcgacatttaaaaaatgaggtgaaagaaagctatagtggcatagaaaaagtataaagctcagttagttttnnnnttattattatnattaaaagttaattcaggactgatgtgacctaccagatttcagaacatgtgttaatagtatatatgccactgaaaacttaggtcctgtatcannctttttnntttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttgggatttaggangtaaaaataaagtatctctgactttctgttacn

SEQ ID NO: 471 - DNA, 2589 bp, Homo sapiens
  Genbank Accession No. D10522
caaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctcctcggccgagaaaggtgagccggccgccgccgctgcccccgaggccggggccagcccggtagagaaggaggcccccgcggaaggcgaggctgccgagcccggctcggccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactgttttggagaacttgtctacaaccagggattgattttaaagatgtctttttttattttacttttttttaagcaccaaattttgttgtttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgt

SEQ ID NO: 472 - DNA, 1929 bp, Homo sapiens
  Genbank Accession No. D10537
ctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggtctcagatgacatctccttcacctggcgctaccagcccgaaggaggcagagatgccatttcgatcttccactatgccaagggacaaccctacattgacgaggtggggaccttcaaagagcgcatccagtgggtaggggaccctcgctggaaggatggctccattgtcatacacaacctagactacagtgacaatggcacgttcacttgtgacgtcaaaaaccctccagacatagtgggcaagacctctcaggtcacgctgtatgtctttgaaaaagtgccaactaggtacggggtcgttctgggagctgtgatcgggggtgtcctcggggtggtgctgttgctgctgctgcttttctacgtggttcggtactgctggctacgcaggcaggcggccctgcagaggaggctcagtgctatggagaaggggaaattgcacaagccaggaaaggacgcgtcgaagcgcgggcggcagacgccagtgctgtatgcaatgctggaccacagcagaagcaccaaagctgtcagtgagaagaaggccaaggggctgggggagtctcgcaaggataagaaatagcggttagcgggccgggcgggggatcgggggttaggggtggagtccgccaaaggcccaaaggtgatggtcatcgagatggagctacgaaaggatgagcagagcccggagctccggcctgctgtcaagtcccccagcagaaccagcctcaaaaacgccctcaagaacatgatgggcctgaactcggacaagtgatcgccacccccccaccccaggccctgccagagcagggggacctaggctcctcttacccccgtctaggtgctttccctctttgctcccccgccctgccctgccctcacctccctttgagacgtaagtttcattccagaattcattccccaggcaattgtattctcccccaccttcacccctggctttctgggagcccaggagctaatcctacccctcacctgccccgggggctgtgtgtttggtgcctgtccacctgagcactgagaagaaagggactttgataccctctgcctcaagtccaggccacctggcattcccatctcctgcatcccccagcctgtccccctggctgtttcctctcccgtccctccctcccctctaccaggtggcccagctccatactctgtccccccagctaatacccagagcacccagatcagactctccttcagggtttatttaggttattattttttattttttaatccattctttgtttgtttacctgtgctcatcctctgcccttacacccatgactgaggaccaatgacgtcatgtggcttttgcaattcacgccccccttaagtccttaatgaagagccagcccaagtagaggggcccctgatcctcacacttcagtatagcattggttccccctgaccactttggagcactgttctgggactccaggtcttgaggagagagacagagagagagaatggatcctcataggtcagggagtgggggagggggcaaatgagccttaagaaatggtttttaaacaaccaaacaaaaagcaggaaaaacaaatgggaaatgggggggcgggggggaggaagaggctgcactgcagccacaggggattcttaggatttttctacattctgtatatttcttctcaaacctccaaatgtccttaaatgtttaataaacactgacatttccag

SEQ ID NO: 473 - DNA, 121 bp, Homo sapiens
  Genbank Accession No. D11789
gatctgaaaaagaacactgtgcgagattgtattcctgcttattctttccaagttagtaggagttggaactatagaatttatccgtgataataataaagttcgcataacttttgttctgaaa

SEQ ID NO: 474 - DNA, 332 bp, Homo sapiens
  Genbank Accession No. D11824
  unsure (1)..(332): n = a or c or g or t
gatcgagaatgtttgcaacgaccgnctggggaagaaggtccgcgttaaangcaacacggatgataccatcggannnccttaagaagctgattgcagcccaaactggtacccgttggaacaagattgtcctgaagaagtggtacacgattttaaaggaccacgtgtctctgggggactatgaaatccacgatgggatgaacctggagctttatnatcancnnnatgagaatcctcatcttcctgccccgctttcctctcccatcctcatcccccacactgggatagatgcttgtttgtaaaaagggaccttaataaagacttagatgttgaaa

SEQ ID NO: 475 - DNA, 404 bp, Homo sapiens
  Genbank Accession No. D11961
  unsure (1)..(404): n = a or c or g or t
gatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccnattttggagttagagggttngttgggtaataaatgtatgatggtncacttt

SEQ ID NO: 476 - DNA, 4211 bp, Homo sapiens
  Genbank Accession No. D13628
gcagcagatagggtagaggaaagggtctagaatatgtacacgcagctgactcaggcaggctccatgctgaacggtcacacagagaggaaacaataaatctcagctactatgcaataaatatctcaagttttaacgaagaaaaacatcattgcagtgaaataaaaaattttaaaattttagaacaaagctaacaaatggctagttttctatgattcttcttcaaacgctttctttgagggggaaagagtcaaacaaacaagcagttttacctgaaataaagaactagttttagaggtcagaagaaaggagcaagttttgcgagaggcacggaaggagtgtgctggcagtacaatgacagttttcctttcctttgctttcctcgctgccattctgactcacatagggtgcagcaatcagcgccgaagtccagaaaacagtgggagaagatataaccggattcaacatgggcaatgtgcctacactttcattcttccagaacacgatggcaactgtcgtgagagtacgacagaccagtacaacacaaacgctctgcagagagatgctccacacgtggaaccggatttctcttcccagaaacttcaacatctggaacatgtgatggaaaattatactcagtggctgcaaaaacttgagaattacattgtggaaaacatgaagtcggagatggcccagatacagcagaatgcagttcagaaccacacggctaccatgctggagataggaaccagcctcctctctcagactgcagagcagaccagaaagctgacagatgttgagacccaggtactaaatcaaacttctcgacttgagatacagctgctggagaattcattatccacctacaagctagagaagcaacttcttcaacagacaaatgaaatcttgaagatccatgaaaaaaacagtttattagaacataaaatcttagaaatggaaggaaaacacaaggaagagttggacaccttaaaggaagagaaagagaaccttcaaggcttggttactcgtcaaacatatataatccaggagctggaaaagcaattaaacagagctaccaccaacaacagtgtccttcagaagcagcaactggagctgatggacacagtccacaaccttgtcaatctttgcactaaagaaggtgttttactaaagggaggaaaaagagaggaagagaaaccatttagagactgtgcagatgtatatcaagctggttttaataaaagtggaatctacactatttatattaataatatgccagaacccaaaaaggtgttttgcaatatggatgtcaatgggggaggttggactgtaatacaacatcgtgaagatggaagtctagatttccaaagaggctggaaggaatataaaatgggttttggaaatccctccggtgaatattggctggggaatgagtttatttttgccattaccagtcagaggcagtacatgctaagaattgagttaatggactgggaagggaaccgagcctattcacagtatgacagattccacataggaaatgaaaagcaaaactataggttgtatttaaaaggtcacactgggacagcaggaaaacagagcagcctgatcttacacggtgctgatttcagcactaaagatgctgataatgacaactgtatgtgcaaatgtgccctcatgttaacaggaggatggtggtttgatgcttgtggcccctccaatctaaatggaatgttctatactgcgggacaaaaccatggaaaactgaatgggataaagtggcactacttcaaagggcccagttactccttacgttccacaactatgatgattcgacctttagatttttgaaagcgcaatgtcagaagcgattatgaaagcaacaaagaaatccggagaagctgccaggtgagaaactgtttgaaaacttcagaagcaaacaatattgtctcccttccagcaataagtggtagttatgtgaagtcaccaaggttcttgaccgtgaatctggagccgtttgagttcacaagagtctctacttggggtgacagtgctcacgtggctcgactatagaaaactccactgactgtcgggctttaaaaagggaagaaactgctgagcttgctgtgcttcaaactactactggaccttattttggaactatggtagccagatgataaatatggttaatttcatgtaaaacagaaaaaaagagtgaaaaagagaatatacatgaagaatagaaacaagcctgccataatcctttggaaaagatgtattataccagtgaaaaggtgttatatctatgcaaacctactaacaaattatactgttgcacaattttgataaaaatttagaacagcattgtcctctgagttggttaaatgttaatggatttcagaagcctaattccagtatcatacttactagttgatttctgcttacccatcttcaaatgaaaattccatttttgtaagccataatgaactgtagtacatggacaataagtgtgtggtagaaacaaactccattactctgatttttgatacagttttcagaaaaagaaatgaacataatcaagtaaggatgtatgtggtgaaaacttaccacccccatactatggttttcatttactctaaaaactgattgaatgatatataaatatatttatagcctgagtaaagttaaaagaatgtaaaatatatcatcaagttcttaaaataatatacatgcatttaatatttcctttgatattatacaggaaagcaatattttggagtatgttaagttgaagtaaaagcaagtactctggagcagttcattttacagtatctacttgcatgtgtatacatacatgtaacttcattattttaaaaatatttttagaactccaatactcaccctgttatgtcttgctaatttaaattttgctaattaactgaaacatgcttaccagattcacactgttccagtgtctataaaagaaacactttgaagtctataaaaaataaaataattataaatatcattgtacatagcatgtttatatctgcaaaaaacctaatagctaattaatctggaatatgcaacattgtccttaattgatgcaaataacacaaatgctcaaagaaatctactatatcccttaatgaaatacatcattcttcatatatttctccttcagtccattcccttaggcaatttttaatttttaaaaattattatcaggggagaaaaattggcaaaactattatatgtaagggaaatatatacaaaaagaaaattaatcatagtcacctgactaagaaattctgactgctagttgccataaataactcaatggaaatattcctatgggataatgtattttaagtgaatttttggggtgcttgaagttactgcattattttatcaagaagtcttctctgcctgtaagtgtccaaggttatgacagtaaacagtttttattaaaacatgagtcactatgggatgagaaaattgaaataaagctactgggcctcctctcataaaagagacagttgttggcaaggtagcaataccagtttcaaacttggtgacttgatccactatgccttaatggtttcctccatttgagaaaataaagctattcacattgttaagaaaaatactttttaaagtttaccatcaagtcttttttatatttatgtgtctgtattctacccctttttgccttacaagtgatatttgcaggtattataccatttttctattcttggtggcttcttcatagcaggtaagcctctccttctaaaaacttctcaactgttttcatttaagggaaagaaaatgagtattttgtccttttgtgttcctacagacactttcttaaaccagtttttggataaagaatactatttccaaactcatattacaaaaacaaaataaaataataaaaaaagaaagcatgatatttactgttttgttgtctgggtttgagaaatgaaatattgtttccaattatttataataaatcagtataaaatgttttatgattgttatgtgtattatgtaatacgtacatgtttatggcaatttaacatgtgtattcttttaattgtttcagaataggataattaggtattcgaattttgtctttaaaattcatgtggtttctatgcaaagttcttcatatcatcacaacattatttgatttaaataaaattgaaagtaat

SEQ ID NO: 477 - DNA, 4187 bp, Homo sapiens
  Genbank Accession No. D13643
ggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 478 - DNA, 1199 bp, Homo sapiens
  Genbank Accession No. D14826
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcgcagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaactaaggcaggagatgcagcagtcctacttattgccatgtggacttgtgggaaggacacgtgtgacctaagaatccagtttggattagtgtttgaaattgaattgggaatgttgttccaggatgtggaatgcagccgtgatcacacttaccgagcttactttgatctgtttgtcaatagcatgcaaaaaagctttgtttgccctttgcttctgctttttttcagggaagctgccaaagaatgtcgacgtcgaaagaaagaatatgtaaaatgtctggagagccgagttgcagtgctggaagtccagaacaagaagctgatagaggaacttgaaaccttgaaagacatttgttctcccaaaacagattactagaaattatttaactatgaactgaaggcagcatgtatagttgcttttgaaggaatacaatatatagctggcaagaatggtggcttcttttctttgtatcattcatcttcttctttaatcattcatcttcttctttaatcacttaacattcctaaaaatgcttcactgtacgtagttaagtcgtagctataacttcaaattttttaaaagggacaaactgtaaaaaatgtgtgtattcttaaaatgcaatatttgtaaggcttgttccaatgccacatacttgcagctcccattctatgtgtcatcaatagtgtcctatgcaataaattatttgcaggtctttaaatcattttaggaaggatgacaaaataagt

SEQ ID NO: 479 - DNA, 398 bp, Homo sapiens
  Genbank Accession No. D20085
  unsure (1)..(398): n = a or c or g or t
gatcangtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagncacttcantattttgttgaagctattgactgtacanttagacattttcanangggtgtaatttatttanngttgtctcattttggtaaaatttatgtgaacttttaaagctaantattaanccttaatatgctatgtaaatnttttccntntataccatttnctggtggtnttttttt

SEQ ID NO: 480 - DNA, 3406 bp, Homo sapiens
  Genbank Accession No. D21063
ctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatat

SEQ ID NO: 481 - DNA, 605 bp, Homo sapiens
  Genbank Accession No. D23662
gaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggccttgctggctactgggtgttagtttgcagtcctgtgtgcttccctctcttatgactgtgtccctggttgtcaataaaatatttcctggc

SEQ ID NO: 482 - DNA, 3588 bp, Homo sapiens
  Genbank Accession No. D25303
ccgcgctcggcgccctgctcgccgggcagaggggaaggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacactgatcccttgctatgaagagtataagaagaagtacggagaggaacacggctcctgccaggctgggatagcgggcttcttcactgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccagaagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaaaaaaaaaatcttctccagatttttcggaggccccactgatgctgttctcttcttcattctatcaagcccaggtgccagcctgaggcagccacttcggccaggtcacacgaccgggggcagcaccacttcgctttaaagactctgaactttggagagtgacagagccgagcaatatttaggatgcaacacgcatggtcaccctcaggggaaaactgttaaagtatttttataaatataagccttttatactgattattcttttatatttgtatcgatattatttctattaaatagttataattcactcaagcactgattctggcctaaaatcttggaagtccatgaatacaaattttaa

SEQ ID NO: 483 - DNA, 692 bp, Homo sapiens
  Genbank Accession No. D26598
cctagtacaccgcaatcatgtctattatgtcctataacggaggggccgtcatggccatgaaggggaagaactgtgtggccatcgctgcagacaggcgcttcgggatccaggcccagttggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttc

SEQ ID NO: 484 - DNA, 996 bp, Homo sapiens
  Genbank Accession No. D28137
gtggaattcatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcaaaaaaaaaaaaaaaaaaaaaaaaaaaaaaaaaaaagaattccaccaca

SEQ ID NO: 485 - DNA, 124 bp, Homo sapiens
  Genbank Accession No. D28423
attttcgtggacgccgggtgagtgagagagttggttggtgttgggccggaggaaagcgggaagactcatcggagcgtgtggatttgagccgccgcattttttaaccctagatctcgaaatgcat

SEQ ID NO: 486 - DNA, 792 bp, Homo sapiens
  Genbank Accession No. D28589
ggagttgcgcgggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgctatagcaaggtcaccagacttgctacaccgaagccctctgggtggcacgggggaggtcatgagaaacgtggattacacccccttgtaaattcctattttcacaagataatatattgtaagccggtcatgagattatatgtggtaaagttaattgactaacaaccccagggtctctctcccccatataaacccctcattttgtaagctcagggctgccacctccgactggtggagaagcctggcaggttaataaacttacttggcctgac

SEQ ID NO: 487 - DNA, 4080 bp, Homo sapiens
  Genbank Accession No. D29805
gcgcctgcggcgccgcgggcgggtcgcctcccctcctgtagcccacacccttcttaaagcggcggcgggaagatgaggcttcgggagccgctcctgagccggagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcgggtcgaacagtgccgccgccatcgggcagtcctccggggacctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttgtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggcgggagacactatattcaatcgtgctaagctcctcaatgttggctttcaagaagccttgaaggactatgactacacctgctttgtgtttagtgacgtggacctcattccaatgaatgatcataatgcgtacaggtgtttttcacagccacggcacatttccgttgcaatggataagtttggattcagcctaccttatgttcagtattttggaggtgtctctgcttcaagtaaacaacagtttctaaccatcaatggatttcctaataattattggggctggggaggagaagatgatgacatttttaacagattagtttttagaggcatgtctatatctcgcccaaatgctgtggtcgggacgtgtcgcatgatccgccactcaagagacaagaaaaatgaacccaatcctcagaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacagctccccttggctcatcattcagatggctttccagatgaccaggacaggtgggatattttgcccccaacttggctcggcatgtgaattcttagctctgcaaggtgtttatgcctttgcgggtttcttgatgtgttcgcagtgtcacccaagagtcagaactgtagacatcccaaaatttggtggccgtggaacacattcccggtgatagaattgctaaattgtcgtgaaataggttagaatttttctttaaattatggttttcttattcgcgaaaattcggagagtgctgctaaaattggattggtgtcatctttttggtagttgtaatttaacagaaaaacacaaaatttcaaccattcttaatgttacgtcctccccccacccccttctttcagtggtatgcaaccactgcaatcaatgtgtcatatgtcttttcttagcaaaaggatttaaaacttgagccctggaccttttgcctatgtgtgtggattccagggcaactctagcatcagagcaaaagccttgggtttctcgcattcagtggcctatctccagattgtctgatttctgaatgtaaagttgttgtgtttttttttaaatagtaggtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctaagtatttttattctggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgcacccacaccccaactccctcccaagaacttcggtcctaaagcctcctgttccacctcaggttttcacaggtgctcacaccacagttgaggctcacacacaggtctgtctgtcacaaacccacctctgttgggagctattgagccacctgggatgagatgacacaagacactcctaccactgagcgcctttgtccaggtgccagcctgggctcaggttccaagactcagctgcctaatcccagggttgagccttgtgctcgtgtcggaccccaaaccactgccctcctggtaccagccctcagtgtggaggctgagctggtgcctggccccagtcttatctgtgcctttactgctttgcgcatctcagatgctaacttggttctttttccagaaggctttgtattggttaaaaattattttctattgcagagagcagctgtgactcatgcaaaaagtattttctctgtcagatccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgtttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgtaccgcgaagtgtgtcatgtgccgtgcccttttctgtttctgtgtatcctattgctggtgactctgtgtgaactggcctttgggaaagatcagagaggcagaggtggcacaggacagtaaaggagatgctgtgctgcctacagcctggacagggtctctgctgtactgccaggggcgggggctctgcatagccaggatgacgcctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctaactttgt

SEQ ID NO: 488 - DNA, 300 bp, Homo sapiens
  Genbank Accession No. D31134
cccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggcc

SEQ ID NO: 489 - DNA, 4573 bp, Homo sapiens
  Genbank Accession No. D31887
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccacaatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagcagaaattagaaaagaaaattaacttatgtggactgtaaatgttttatttgtaagattctataaataaagctatattctgt

SEQ ID NO: 490 - DNA, 2104 bp, Homo sapiens
  Genbank Accession No. D42073
gctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaattacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagatttttatatttgccactgttagatagttggaaaggggaaattctgtttaagcgaaagtggtatcatcctaggtaagcttatttcagaacaagtctaatatatcagattctttcttttcgactttatactctgagttattacttactgtaagtggtgtatatgaaacctccatgcattttccagtatggatctgctaatatgcacagtaaatccatgtctttgtttgtttttctattaagaagcaatcaagaaagataatgtgaaaaagaaaggaatttagaggtagggaaaagatgaatgtcagacatgtgaagaactatagtaaaaatgataaaccacctaaatatccttgaacctaccttaaaatgccaatgaggtaggcctgatctttgaatagtggctaggatacaatgcatttcctcagtgatcactgattagaatgagttggtgggatccttgggaagccaaacggagcggggttctggatcatgtcccatccagtccagtgaatccccgacccgcagacctgccccccccgcaacagcttataccatggaatgaggacaaggtgatactctgagctgtggactgaactggcagacacaacctgtacagattgaaatttcaccttgtaaggaggaagtgaatgaaataaaggatccccctaagg

SEQ ID NO: 491 - DNA, 419 bp, Homo sapiens
  Genbank Accession No. D45370
ctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctcctgaaatgacagcagggagacttgggtcggcctcctgaaatgatagcagggagacttgggtgaccccccttccaggcgccatctagcacagcctggccctgatctccgggcagccaccacctcctcggtctgccccctcattaaaattcacgttcccaccctgaaa

SEQ ID NO: 492 - DNA, 1344 bp, Homo sapiens
  Genbank Accession No. D50532
ccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctccgctctgggccctgccatctcctgctgtccctgggcctcggcctgctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatggtgaggaagcctccactgaagggacctgctgccccgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagt

SEQ ID NO: 493 - DNA, 3806 bp, Homo sapiens
  Genbank Accession No. D50550
atactatactatactattcaattctttcaattctagtaatccaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccggggacatagcaggcctgggcactgagggcagcagtgtcttcttcctggatgttaccaccctgaccctgctcgaggggcagacgcttgccccaggggaggttctgcgcagcgtgccagacgactaccgctgtgggaaggcactgggccccgtggagtcactccagggacactgcgggaccccacaaagattctcattggctacagaccggggcctgctggtcatctggaaccagtcccggcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcctacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttcctgccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgctggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatgggcccaccacgggtcccaccatgtgggctggcaccaactcaggctctgtgttcgcctatgcactggaggtgccggcagcagcagtgggtggtgagaagcggcctgagcaagcggtggaggccgtgctgggcaagaaggagcagctgatgcaccgggcgcctgtggtggccatttgccgtgttggacggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgttttgccagtgtggcctgcagactatgctgagacctgcctggcctgtgctcaccaacctgggtgacgtccacgtcttctcggtgcctctgcggccccaggtgcactattcctgcatccgtaaggaggacatcagcggcatcgcttcgtgcgtctttacgcgccatggccagggcttttacctgatatccccatcagaatttgaacgcttctccctaagtgcccggaacatcacagagcgctctgctctctggacattaactggccccgcgatgccacccaggccagttacaggatccgagagtcaccccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctgacacgacaggggacgtcacagtggaagatgtgaaggatttcctgggctcctctgaggagtcagagaagaacctgaggaacctggcagaagacgaggcccacgcctgtgccatcctgatcaaataaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtgggggcccagcacctgtgccacctccccccctccacacaccatccttccccctcactttgcagagtatttttccttttttttttttttcttttttcttaaagacggagtcttgctctgtcgcccaggctggagtgcagtggccccatctctgctcactgcaaagccccgccttctgggttcccgccattcttctgcctcagcctcccaagtagctgggactacaggcgcccaccaccacgcccagctaattttttctgtatttttagtagagatggggtttttcaccatgttagccaggatggtctcg

SEQ ID NO: 494 - DNA, 3233 bp, Homo sapiens
  Genbank Accession No. D50928
tgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggcggttaaagaagaggggcaagatcctgatgaaattggcatcgagttagaagccaccagcaagaagtcagccaagagatgtgttaaaggactgaagatggaggaggaaggcacagaagataatggcctggaagacgattccagagacgggcaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtggatggggaaggatttaagaacactttggaaacttcatcgttgaacttcaaagtaactccggacattgaagaatcccttttggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagctcttttaaggaagaaaaagatataaagccaatcattaaagatgaaaaaggtcgggtcggcagcggttctggtcggaacctgtgggtcagcgggctgtcctccacaacacgcgctacggatctcaagaaccttttcagcaagtatgggaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggccaaaaatgagcctgctgggaaaaagctttccgacagaaaagagtgcgaagtgaagaaggaaaaattatcgagtgtcgacagacatcattctgtggagatcaaaattgaaaaaactgtaattaagaaggaagagaagattgagaagaaggaggaaaaaaagcctgaagacattaagaaggaagaaaaagaccaggatgagctgaaacccggacctacaaatcggtctagagtcaccaaatcaggaagcagaggaatggagcggacggtcgtgatggataaatcgaaaggagagcccgtcattagcgtgaaaaccacaagcaggtccaaagagagaagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcgggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccgacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggcgggagggttcgaggccaatgatgggagaccaccgggatgggcagcactatggagatgaccgccatggccacggaggacccccagagcgccacggccgggactcccgtgatggctgggggggctacggctccgacaagaggctgagtgaaggccgggggctgccccctccccccaggggtggccgtgactggggagagcacaaccagcggctagaggagcaccaggcacgcgcctggcagggtgccatggacgcaggcgcggctagccgggagcacgccaggtggcaaggtggcgagaggggcctgtctgggccctcggggccggggcacatggcaagccgcggtggagtggcggggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgtgagttttcgggtgggcagacgcactgttgaatctggtagccagggttccctcgaacttgggggatctttttaaaagcaaagtaaatcctgccaccatgttgtagctcaatacaatgtgaactcacttttttttttttttttaataaatgtgttcttgttctgccatttttaaatcaaggtttctgttaacgaggcattccattttccattaataaagtttaccattcgcaaaaaaaaaatgtgttcttgttctgccatttttaaatcaaggtttctgttaacgaggcattccattttccattaataaagtttaccattcgc

SEQ ID NO: 495 - DNA, 404 bp, Homo sapiens
  Genbank Accession No. D51060
actttyccaatagtttwatttgtatttttctttaaatatccttttctggaatttttcagaaacaaaacataaaaaaattatatactttattacaaatkggaaactcagagtgctccaaatctcttatttacaaacaacactgggcaggatacccaaacaaacaaacaagaaatwcttacaaaggcatgaagctgtttattgacagtaatcagctttcatcaaattaaaaaatatatatwtbtwcatacacagttaacgaggcaggccagaaagagttyatctgtaggctcagcctcgctctcacctcgtgccgaattcctkcagcccgggggayccactagttctagagcggccgccaccgcggtggagctccagctttttttccytttagtgaggggtaattg

SEQ ID NO: 496 - DNA, 283 bp, Homo sapiens
  Genbank Accession No. D51069
ctgggacaattaagctttatttttcatatatatatatayyyycatatatatatatacatacatatataaagggaacaatttkcaaatttacacaactgacaaaaccatatatacacacatatgtatgcatacacacagacagacacacacacccgaagtctctagccaggcgccgtttymcatcccyaagtaccattctctcatttgggcccytctagggktggggcccycgtgccgaattcctkmagcccgggggatccmctagttytagagcggccccacc

SEQ ID NO: 497 - DNA, 310 bp, Homo sapiens
  Genbank Accession No. D52692
attcttagggcatctggatatttattgagaagccacagttttccacacttccataactgtaggctttatataaggcaaagcaagatggatccactactttacatggraagamatagctctgcagcaaaccccagggktgtgcagttacagatcaaaatgcaatgtacatgacagatataavvrcvcagtgtggracaaaataatttaaattatggttacaatctactgaagraatatccacatcttatataaacacatttttagtctagggktgtatttaaatattcgktbtacatacacagttgagacg

SEQ ID NO: 498 - DNA, 347 bp, Homo sapiens
  Genbank Accession No. D60074
  unsure (1)..(347): n = a or c or g or t
gtaaaaactggtttatttttttaaaaataaatacaaaaatataaatvtannnnnntvgcagatagamttygatgaaatgaaattgcacaaatgtctgtataccaggttgcatatcacacctactaacatcacatgtacatttttgtttttttaatttaatgtacagaacaggatatactgtaaaabtyttcttcacctttttaaaagcttcatttgcaagggcaggvcatgtacctaacagaagcggcttgtttgtgaggttgcttaagggrgaactatcctgttcatgtttctgaaattatcttttatttactaagrtggacaacactgtatttccatagctttgg

SEQ ID NO: 499 - DNA, 310 bp, Homo sapiens
  Genbank Accession No. D60272
agaattaaatctgacaggaaaacctaggrgtttttattagtaccattattgttttctttggctccatgtattatgtcggtaaaatgacaaaaaaaaaaaaaggaaaaaaattktaaaagacaaatattttgtacaaaaatacaaagttttaaaagctctttaagtatatyccatattatyactaatagtyggccyatatatcttatgcctgcatatttybcctacacttggwttttagaaatgtatggcactktttacacagtatatgcttavgbbctycccataactcavsgcccaatgatamcctttt

SEQ ID NO: 500 - DNA, 293 bp, Homo sapiens
  Genbank Accession No. D60755
cgttcgttaaatctttattgaygcgtggacactcctbcccctccagccccgccccccagccccagaaatactagaaagcgcaccataaaacgagggcacgagattgtbgtcccattcacgacggagctgagggggaggtgtgcaggttccagcctagatgttcaggattgagatgtgggtcgtgaaaggaaagtgggttttccgggatgtgggggcttttctvagcactgggtccactgacgctgctgytcccaaggggatgctaggacyccgytcaggcaggggtgggctcg

SEQ ID NO: 501 - DNA, 354 bp, Homo sapiens
  Genbank Accession No. D62584
catttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttcctgacttaaacctcactgagagcgcaaaatgcagctttatactttttactttcaattgcctagcacaatagtgagtacatttgaattgaatatataataaatattgcaaaataaaatccmtct

SEQ ID NO: 502 - DNA, 482 bp, Homo sapiens
  Genbank Accession No. D62965
aaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaacaacatctcagactttacaaagaatgacaagaaggcaattgcactttttagggatatcgccaagcagtttctgttttctaaaggccaaaatacagagtgtgtgtcatttttattagat

SEQ ID NO: 503 - DNA, 1375 bp, Homo sapiens
  Genbank Accession No. D64154
gcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcactgggggccagcggaacgagcggccacgaactctctgcgctaggcggtgagggtggcctgcagagcctgctgggaaacatgagccacagccagctcatgcagctcatcggaccagccggcctcggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcctttacctgcaaaaaaa

SEQ ID NO: 504 - DNA, 383 bp, Homo sapiens
  Genbank Accession No. D80059
gggtctgtgagccaataaaactttatttacaaaagcaggcgacaagtcagaccyagcctgattgggccttgttttccaacccttagactgcatccactttgagaaaagtyttgtcaaaagcatcattttagcgctttcttttagaggcagggtcctgacaactcttgattaacacacacatccaggcactttgtytctyttcctccgttgtcctttkataaacaccaactggcagaggggacatggagcattttttcttcaattgcagtgattctttkagggaaaggggccytcaggagcattgttcacattctccgbyttgtcctgggaggcagttagaggatgtkgtcactccagaataatttwttkaktcacatacttyt

SEQ ID NO: 505 - DNA, 328 bp, Homo sapiens
  Genbank Accession No. D80063
agtttttattmggaattgtccattgaatgttagctaaaacagtcaataaaaygcattamgtgccagctgcatgcaagcccctamgttagatacaatcmgccctcttcatcagcaggtccacatcttcmgattcaactmgaygcggctgaatatttgamggaagaaaaaataaaaatacaaatmgaamgawacagtataacaacygttkccattatacaatatctatacatttcgttagtgatgacttcaagtacaygggaccaggcacggtgactcacacttgtatyccaacacttcggaggscaacctgggagsatagtgagacctt

SEQ ID NO: 506 - DNA, 377 bp, Homo sapiens
  Genbank Accession No. D80237
ccycatgcagccccaaagggvaaaaagrgactttaattaggggagggaggatccaccagaatcagaaaagggacagytagcgtgggagcagaggrgccagaacaggcaggrggrgggcccggccaggaagytytggrggactcacctcgccacctytggcacaggcactggcactgacggacaaggsgaaacagcggcccctctcaactgggrgggcaccaatggcccctgtagccagaggttgcccggcttttgggccccaggtcctaggcatgactggtggtcaccaatttggcccttktccccaaccagtgctggggggccatctttaggcagaactcaggaagcctcgtsccgaattcctgcagcccggggga

SEQ ID NO: 507 - DNA, 225 bp, Homo sapiens
  Genbank Accession No. D80298
actttaaaaataagtttattataactaacgaatataaaatctgacagatattttcaaacatttttgcaaaaaaagtaaaaccctcccctgbsacccctccccacaagatagagaataaggacttggacagagaaacaatacamatctaamcatgaaactgtcgctcatcggttggtcccargaggctccamcatattatattctargwaarggtccattaaatta

SEQ ID NO: 508 - DNA, 295 bp, Homo sapiens
  Genbank Accession No. D80617
aacaaacaattgtgtttattgacaagttcatacatcagtacaaacgggcacgttaaaaacagcgcccccgccccatgcagccgaggatgaggcaggaagcgccgcgacctgcacaaagtataaaagttataaataaggggctttcaaaacagggcgggggcaaatctggagtggggcggcggttgccggtggcctcagacatgcagaaggggacggggcgccggccgggccacgaggccccccacccacatggggcagagggcaggaaaagggcggccacattctcctcgtgccg

SEQ ID NO: 509 - DNA, 351 bp, Homo sapiens
  Genbank Accession No. D80738
  unsure (1)..(351): n = a or c or g or t
cagtcagbbcattcagctttattncagbgctggtttttggttcsctaagagctgcatgagtgctaggcttcavcacgtgactgggggccccttgggamctgggtactatgggcaggatgcccctgaaaagaactgaagacagaggaatcatacttctctttaatacctvtggggaaggcccaggctaaggatgagggcagggaccagtcccagtgccccctggggagagaagagggagamgcttgggcacaaactcccagtggbcctgcaaggctatcatccctggatcttgctggagtggacagtcttctgggccagggttgttctagcttktttctcactgtacctaat

SEQ ID NO: 510 - DNA, 313 bp, Homo sapiens
  Genbank Accession No. D81655
tctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagccccccagccccgcactgsggttaatttatgtgttgtttaaaatgcggctgctctgcttcctgcctctgcttctgccsgatccchaawaaaatgkgggggcccc

SEQ ID NO: 511 - DNA, 1425 bp, Homo sapiens
  Genbank Accession No. D82346
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaagg

SEQ ID NO: 512 - DNA, 493 bp, Homo sapiens
  Genbank Accession No. D82534
  unsure (1)..(493): n = a or c or g or t
aagcagtatgcctgtttgcacgatttaactaacaagggcattggagaagaaatagataatgaacacccctggactaagcctgtttcttctganaatttcacttctccttatgtgtggatgttagatgctgaanatttggctgatattgaanatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccancctttgcgtattgtggtcactcattttgttgtacaggaacagctttaanaactatgtcatcactcccanaatcttctgcaatgtgtagaaaagcagcaaggactagattgcctaggggaaaagacttaatttactttgggagtgaaaaatctgatcaagaaactgggacgttgttacttcctgtttcctcca

SEQ ID NO: 513 - DNA, 3198 bp, Homo sapiens
  Genbank Accession No. D83018
ttgggaggagcagtctctccgctcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 514 - DNA, 9078 bp, Homo sapiens
  Genbank Accession No. D84294
ctgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaaacccttagtctgaaactttagcaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtgtatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgag

SEQ ID NO: 515 - DNA, 4121 bp, Homo sapiens
  Genbank Accession No. D86976
acaatgtggtcccgaagcggccagcgccgggagctgcagcgctgagacccccagcccgccccctcgggctcccggccggggccccatcatgttctccaggaagaaacgagagctcatgaaaaccccttccatctcgaaaaagaaccgcgcgggaagccccagcccgcagccctcgggggagctgcccaggaaggatggggctgacgcggtgttccccggaccaagcctggagccgcccgctgggtcctccggcgtcaaggccacagggaccctcaagcggcccaccagcctgagccgccacgccagcgcggctggcttccccctgtcgggtgctgcctcctggacactgggccggagccaccggagcccactgacagccgccagcccgggcgagctgcccaccgagggtgccggcccggacgtcgtcgaggacatctcccatctgctggcggacgtggcccgcttcgctgagggccttgagaaacttaaggagtgtgtgttgcgtgacgacctccttgaggcccgccgcccgcgggcccacgagtgcctgggtgaggctctgcgtgtcatgcatcagatcatctccaagtacccgctgctgaacaccgtggagacgctcaccgcagccggcaccctcattgccaaggtcaaagccttccattatgagagcaacaatgatctggagaaacaggagttcgagaaggccctggagacgattgctgtggccttcagtagcacagtgtccgagttcctcatgggtgaagtggacagcagcaccctcctagcagtgcctcctggggactcgagccagtccatggaaagcctgtatggaccgggcagtgagggcacgcctcccagcctggaagactgtgacgccggctgcctgcccgccgaggaggtggacgtgctgctacagcgctgtgaggggggcgtggatgccgcactgctgtatgccaagaacatggccaagtacatgaaggacctcatcagctacctggagaagcggacgacgctggagatggagtttgccaagggcctgcagaagatcgctcacaactgcagacagagcgtcatgcaggagccccacatgccgctcctgtccatctactcgctggccctggagcaggacctggagttcggccacagcatggtgcaggcggtgggcaccttgcagacccagaccttcatgcagcccctgaccctgcggcggcttgaacacgagaagcgcaggaaggagatcaaggaggcctggcaccgtgcccagaggaagctgcaagaggcggagtccaacctgcgcaaggccaagcagggttacgtgcagcgctgcgaggaccacgacaaggctcgcttcctcgtggccaaggcggaggaggagcaggctggcagcgcgccgggagcaggcagcacggccaccaagaccctggacaagcggcggcggctggaggaggaggccaagaacaaggcggaggaagctatggccacctaccgcacctgcgtggccgacgcgaagacgcagaagcaggagctggaggataccaaggtgacggcgctgcggcagatccaggaggtcatccggcagagcgaccaaaccatcaagtcggccacgatctcctactaccagatgatgcatatgcagacggcgccgctgcccgtgcacttccagatgctgtgtgagagcagcaagctgtatgacccaggccagcagtacgcctcccacgtgcgccagctgcagcgggaccaggagcccgatgtgcactacgactttgagccccacgtctccgccaacgcctggtcccccgtcatgcgtgcccggaagagcagcttcaacgtgagtgatgtggcgcggccggaggctgccgggagccccccagaagaaggcgggtgcactgagggcacacctgccaaggaccacagggccgggcgaggacaccaggttcacaagtcatggccgctctcgatctcagactcggacagtgggctggaccccggccctggcgcaggggactttaagaagttcgagcggacgtcatccagtggtaccatgtcgtccacggaggagctggtggacccagacggtggagccggggcttcagcctttgagcaggctgacctcaacggcatgacccccgagctgccggtggccgtgcccagtggaccgttccgccacgaggggctgtccaaggcggcccgtactcaccggctccggaagctccgcacgcccgccaagtgccgcgagtgcaacagctacgtctacttccagggtgctgagtgtgaagagtgctgcctggcctgccacaagaaatgtctggagacgctggccatacagtgcgggcacaagaagctgcaaggccgcctgcagctgttcggccaggacttcagccacgcggcccgcagcgcccccgacggcgtgcccttcatcgtcaagaagtgcgtctgcgagatcgagcggcgggcgctgcgcaccaagggcatctaccgggtcaatggggtaaagacacgcgtggagaagctgtgccaggccttcgagaacggcaaggagctggtcgagctgtcgcaggcctcgccccacgacatcagcaacgtcctcaagctctacctgcgtcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggacgagtcatccaaccagcgagctgaggtagtcgtccaggtgccgtacctggaggcgggcgaggcggtggtctacccgctgcaggaggcggcggcggacgggtgcagagaatcccgagttgtgtccaacgattcggactcggacctagaggaggcctccgagctgctgtcctcatcggaggccagtgccctgggccacctcagcttcctggagcagcagcagagcgaggccagcctagaggtggcttctggcagccacagcggcagtgaggagcagctggaggccacagcccgggaggacggggacggggacgaggacggcccggcccagcagctctcaggattcaacaccaaccagtccaacaacgtgctgcaggccccactgccccccatgaggctccgtggcgggcggatgacactgggctcctgcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctcccagaggcttccaggagcacgagggccttgcggcacaggactgtgccctgtgctgtcccctgcaccccggctcagctgagctggggaacactgctgtcgtgtgaagtcacagtggccttgttggtgcccacagggctgtgtggatggaggaagctgtccctgcccagtgcatcccccaggtcatcacggggacgcaggaggcaggccctgccctgccctctcctcacaggtctgttgcagggactccagaaaccattctgggagccgtggatgggggcggagctggggtttggtgcagtttccagggtgcagtacagcagggcctgaatactggccctggactcccttttccagaacaccaggtgtggccacctggggctcaggtacacagtggggtctctcggaagccaccgtgtggttctttcacaggcacgtttattttgctgaaataaaaagtttttaatcggg

SEQ ID NO: 516 - DNA, 2036 bp, Homo sapiens
  Genbank Accession No. D87258
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacaaa

SEQ ID NO: 517 - DNA, 1137 bp, Homo sapiens
  Genbank Accession No. D87292
gaattccgggcgcggcgtccggggcgagtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggactggactcgggccatatccgtggtgccgtcaacatgcctttcatggacttcctgactgaggatggcttcgagaagggcccagaagagctccgtgctctgttccagaccaagaaggtggatctctcgcagcctctcattgccacgtgccgcaagggagtcaccgcctgccacgtggccttggctgcctacctctgcggcaagcctgatgtggccgtgtacgatggctcctggtccgagtggtttcgccgggcccccccagagagccgtgtgtcccagggaaagtctgagaaggcctgagccgtgacctcttctgcttactgtaactgcggccggtttagtgaccccatgacttacagccggttcttacctcttaggtgaaggagatgacatgttttttagaattgctgtgcaaggctcaccctctctctgtcaacactggaataaactttgccttttctgaaaaaaaaaaaaaaaaaaaaaaaaccggaattc

SEQ ID NO: 518 - DNA, 5316 bp, Homo sapiens
  Genbank Accession No. D87465
cggacgcgtgggaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagaccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcagaagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtaacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcctgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcaacaggaggaggctgtggctgcagagcctggaggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcccgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccatatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccccactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccctgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 519 - DNA, 215 bp, Homo sapiens
  Genbank Accession No. F01684
catgatctaatttggtttactgaacttagaaaggtagactttcaaggaaaaaacatcgatttccaccaatagtaaaagctactgcatcagacctgtcactcaacagcgctccttgaggcctagctcctgagatccctctggcgagcccttgcggctccacatcctcgggacggcacgttcccacaggactggagcaaaggtttcagagactcggg

SEQ ID NO: 520 - DNA, 217 bp, Homo sapiens
  Genbank Accession No. F01920
  unsure (1)..(217): n = a or c or g or t
aacagggataggcaaacagctctttattccaactccattagtgatatgaaagaaagacaatccaagtcagtaatggaaatatgcaagangttcaatttaggtgaggtgaatttttgcatgtgctttaacggttgaggtttagtgtatattgtactttttacccttaaggccaagtaattggcaactgtgaaccattaatgtaaaatattgataataa

SEQ ID NO: 521 - DNA, 205 bp, Homo sapiens
  Genbank Accession No. F02204
caggagaagcctgtttattaggcaggagaagcagcagggcagccaggctcccctcccagccaccagctggccaaatgtcctcccttaactcaggggtacccaaggctccatggccatgtgaccagaggcgtgtaccctcaagaggcggcccctcagccctgggcagcccagccactgggtctcgcccttcaggggcctgcgcccc

SEQ ID NO: 522 - DNA, 298 bp, Homo sapiens
  Genbank Accession No. F02245
gggggtggcagtgcactttattaacaaacaaaacagtaccatacaggcaaaatcttacttcagtggcaaagcacacacataggtatactccaacgtgtagcactggggcaaacttcagacatggaacattaggcaccaagttcacaatcacactaaacatagttcacaatccttcaatccatactcttcagtggaggatgaggccttatttaacagttaactgggacagacagatgaagttttaaaatctaattcttggcctaactgtggagtggggctgactcagccttcagaactg

SEQ ID NO: 523 - DNA, 212 bp, Homo sapiens
  Genbank Accession No. F02333
gcattaacagtaaccccaagaaaggcatcagggttctggagtggttgtttgagtgacacagcacaaggccttgatttcatcatgcttttgctgtggatgtagtgtagcttgctgaacaggtatggaagctgtctttgctgttaagtacttctcccgtttgtttatcaacctgcagctaacaggatgtctgcttttttacaggtttatttcac

SEQ ID NO: 524 - DNA, 221 bp, Homo sapiens
  Genbank Accession No. F02470
gtttcacatgagtgaaaaaattaacagctgccctcatttctgaaaacaaaaaactataaacaatcactgttgctcccaatgggaccgttggacataagccctgaggctttggggtcaacgggctagactctagaagcccaggaccccgccaaggtcatgtctgcatacttggggcagggcgagctgttgaaccatcgcatttctctgctgcttctttacat

SEQ ID NO: 525 - DNA, 315 bp, Homo sapiens
  Genbank Accession No. F02739
  unsure (1)..(315): n = a or c or g or t
aaatctcttctgtgtgtttnctttttttgttgcttttttttcctcttctgtttgtgtttttttgtcgcttttttgattttttncttttttgttccttgcagcagaagctccacagacgtttaataacaacaccgggaggggtgggggagagagagctggacagtcagatgggggcgccatagccagacaccaaacgtggggacaccgggggaaggcaacttaactatagctaaagtcgggggttttgcaattctcagttccgatggggccgctgagtggggtggggagcggtgcgagggctcccaggggctccgg

SEQ ID NO: 526 - DNA, 312 bp, Homo sapiens
  Genbank Accession No. F02992
  unsure (1)..(312): n = a or c or g or t
aagaattttagtttttttcttcccccagactttttttttttttttttttttttttttaaggaaaaaaacccccgccaaatctgaaccgcgttgtagctcggtccccgcctcctcagcgggctgtcgcgtgcaacaaacctcccccatcatcttagaaaataattatagagcgcggcgccccgccctcgntcctgccagtgggcgntttggtcctattttttggattatttcattacgaagcacgtgaatgaatctagcccccacaccttcaagaaagaaactcgcggactggggttgaaaagcccaggtggg

SEQ ID NO: 527 - DNA, 202 bp, Homo sapiens
  Genbank Accession No. F03254
  unsure (1)..(202): n = a or c or g or t
attcatggtcgantattatttattgtcagaaaggtacagcattcacaccaatatcagacaaaatagattttaactaaaaaattatttcgngacaaaaataacaatatatgtnaataaaaggctcaattaaaaatgtataacaattataaacacatacacatcaaacaacagtnccccaaaatacataaagcaaacattgaca

SEQ ID NO: 528 - DNA, 305 bp, Homo sapiens
  Genbank Accession No. F03969
  unsure (1)..(305): n = a or c or g or t
gaactttgggaaaattatttatttctccccacggggttcagacaagtaatttcacatttcattgtaagtcaagggtaagaaaacattttttgtacatccatcactaatagagatcacagtatgtcaatgaaatatttaaatacactgtacagagattgctttttaatggatttctataagtagtattaataggaaaaagcatataatacaatctactctgtatctaagagctttaatttattcaaatattggaagaaattcatctnctgaattttncttatttaaaaagcattatgagaactgat

SEQ ID NO: 529 - DNA, 261 bp, Homo sapiens
  Genbank Accession No. F04019
  unsure (1)..(261): n = a or c or g or t
cctcttcataaaaaaatatttattagtttgaacatcgatttaaaaaaaaatcagtcacataaaaaaaacccttcatgncatgtcttttccctccacgcctcctgagatggacgtgctcacctgggcctcggaaatcccacactcttcagtcggcaaactgcgaacaagaacaggaaatctgccacgcgcaaacacttggggaggtcagtgggacactgttggttttagggaagaaaatgcccctgtagctccggcggggaa

SEQ ID NO: 530 - DNA, 335 bp, Homo sapiens
  Genbank Accession No. F04112
aatagagatgggggatctcatcgtcacccaggttggaatgcagtgataccatcacagctcgctgcagcctccacctcctgggatcaacccctacctcattctcctgactgggactacaggcactcaccaccacactgggctaattaaaaaaaaaaattcttttttgtagggaagtggtcttgctatgtcacccaggttgatctagaactcctgacctcaagtcacccgtccgcattatcctcccaaagtgctgagattacagacgtgagccactgcacttggcctatttagggcttctaattcactttccttttccttcttgtctaattcttgtg

SEQ ID NO: 531 - DNA, 178 bp, Homo sapiens
  Genbank Accession No. F04492
gtagagacggagccatccatgtttcccaggctggtctcgaactcctgggctcaagcaatcctgccgcattggcctctcaaagtgctgcgattacaggtgtgagccattgtgcctggccaaaatgtgtatttttaatatgctgctgagttgactcttgtatgatcaggaggagcatttg

SEQ ID NO: 532 - DNA, 211 bp, Homo sapiens
  Genbank Accession No. F04816
  unsure (1)..(211): n = a or c or g or t
gatgtaacatttgtnattttattggaaaaagctggtattaacatatttatagttttattcaacaattgggtaatttgtgagacaccaaagaaaaaaagaatgcacctatgagttacagagtccaaactgatcagggctgacaacttgaccaccatgtntcccacaccaccacccccaccaccaccaccaccaacagcttcgtcctcagaga

SEQ ID NO: 533 - DNA, 276 bp, Homo sapiens
  Genbank Accession No. F09281
  unsure (1)..(276): n = a or c or g or t
actgtttaaatataattgaagtttttnatatgatgaagtgctccataatttaaatgtaaaaaaccaataggaaatatatgaaataaaataaaattatacgtaaaagtgacaatgcctctattagatttaacagtatcttacaatagaataagttgaaacctacaaaatggaagaaagtttaaaattaggcagatattatcancctggtgaagaataaatacatatgtcaataagcatttaatgtatttggtcttagattttacatgaaataataaa

SEQ ID NO: 534 - DNA, 293 bp, Homo sapiens
  Genbank Accession No. F09315
acagaaattgacctttatttgttgtactaaagcctgtttaacttttgatacaaagtaacattttagtacagaaaatcccagtctgtcagctcagtacctgtctgtgcacactgtaccatctcagtcccactctgcctgtaacttagaaaacagcccctacccccagaggtctgcgagttaataccttgagaatagtctacagtttttcatagtttgtctgagctagaaaacttgtacctgtaaaacaaaggacagcattgaggactgaaacttgtctcttttttgaacaactg

SEQ ID NO: 535 - DNA, 214 bp, Homo sapiens
  Genbank Accession No. F09684
gctttacataaacttataaggattttttatttaaaggatttaaaaatataacacagtcaatataaacatgtactgggaattataaaccattctttcttctaagcactggatgagatactaaaaacatacagtatcttaccaatagccattaaaataggctaaaatgaaaaagaaaccgttgtaacaaggttactaatcccccaactttcaatgc

SEQ ID NO: 536 - DNA, 332 bp, Homo sapiens
  Genbank Accession No. F09748
gaatgaaagaatccagcagatatttattaagcaagatgaaagtgaaattacaaacacaggtcaacttttaaactcagcactctgttggagtggaggtgcacggtccttcatcataggcagcctatgcgagatgcatcttaggaagggagctttcgctgctcagaaatcaaagctccatcggaggtgtcctactggaggcatcagacaacaagctaaatgacgttagggctacacaacacaaaggggaaagttgacaacaattcaggggctttgagtagtcaagacaattagcttagtacttcaggtcaataaatgctacaatttatgggcaa

SEQ ID NO: 537 - DNA, 332 bp, Homo sapiens; identical to SEQ ID NO: 536
  Genbank Accession No. F09748

SEQ ID NO: 538 - DNA, 247 bp, Homo sapiens
  Genbank Accession No. F10078
  unsure (1)..(247): n = a or c or g or t
catgccttgaggaaagctatttatttccaagatatagactgtacttttaagacaggacttttcagaagcaggaaattttagttgttgccagagaggtgtgtcaaggacacagtgaaaggagccatgcggacatggggtggaaggctttntccaacactgttacaacacttttgtaaatgagcaaaacatctttaaaaatccttataaattctttataatatgttacacatttagagacaatatttac

SEQ ID NO: 539 - DNA, 366 bp, Homo sapiens
  Genbank Accession No. F10193
aacataagtcgagaatttatttgggccaaatttggggactgcaaccaaggagacacagattcaagttgccatgaatatatgctttgattagcagtagtacaagttggctttcaatactcatgtctctctggatctgatacattttgcatacctcacatagctcagacatctctgagctactttccttctcatttcccctttttgattgagatcttcctcttctgaaagcattgataatcaacattttaaacgtagcttttccccatattgctaggaaggctcattcccgggtaatctctctctacattggagggaaagaggagaggcactacagcttaagaatttagtgaagtcttaggctaaatt

SEQ ID NO: 540 - DNA, 179 bp, Homo sapiens
  Genbank Accession No. F10323
  unsure (1)..(179): n = a or c or g or t
aatttataaatgctttattgaaaaatacacttatcttcatataaaattacagtagcagtatcttgagaagttttataaatatttttgcagacactattctaattgaacaatgtaagtnccatatttctctcagcaatatgaagtncctagtaacttngtttatactgattcaattacaa

SEQ ID NO: 541 - DNA, 256 bp, Homo sapiens
  Genbank Accession No. F10980
  unsure (1)..(256): n = a or c or g or t
gacttaactcaggcaacttttttttttaatttncctttttcgtatttcctagttatagatggagtttgcaggtcttaggccaatcttcaatacaaatnctttggagcagatttaattgacagccctgtccctttctcagtcatattacaaaaagaagcatacacttaacaccaatgacccgtcaagatgcttaaactgttacaaccagtttccattaaaaaactgagaagtacataacacgcagaaaggaagcaag

SEQ ID NO: 542 - DNA, 243 bp, Homo sapiens
  Genbank Accession No. F13763
ttttttttttactttaatttttcttttattttcactgacagaaaaattttctggagagtacaatcaagatagtgtattattagaaataacattaatagaagcttggtcagaaatgataatagtcataataagcatctctctcaccaaggcattccacacagagagatcacagcacaataaataaaggatttctcatttgccacacaacaaataaaacaattgcagtaacaaaaatatgacttt

SEQ ID NO: 543 - DNA, 342 bp, Homo sapiens
  Genbank Accession No. H01068
  unsure (1)..(342): n = a or c or g or t
taacttcagtctcaatcttacagtcacactttgaaaatacattctgtatagatactaactaatgcaaagacttatatatgtattgttcattacagcagtgtttgtagaaggctaaaaacaacctaaatatctgtcaatagaaaatggnaaaataaattacggaaaatgaataaattatggttcatctacactagcaaggcatgcggtncttttttaaaaaagtaagaaatatgtgctaaatacaaaangatcttcatatgccaaaggataaggaatgaaaggatacaatatatttctcctaggncatatggtggattggaatatgggttgcttgggattggg

SEQ ID NO: 544 - DNA, 415 bp, Homo sapiens
  Genbank Accession No. H01824
  unsure (1)..(415): n = a or c or g or t
attcacaanaannnnttttattattcttaacagtactcactttaaaggaataagaggatagcatacattttttacagacaatatataaatgttgtacataattaacaataacttagttcactaatccaaaataaaacaagccaaataaaacataaaaacagaaaatactgccgnttctttttcttatgcgggacactagntacaaaataagttacttctgggccgtgggtgctccctgcaggcgactgcccgcccatattgcacttgggtcactaacatcaggcacaatcctcctccgggggccggggccccttcancagggcccaccacaccccgccgttcaccggcattacaggaatcttaggcttgggggacaggtttattattacagctgttaccttggggggnggggttc

SEQ ID NO: 545 - DNA, 309 bp, Homo sapiens
  Genbank Accession No. H02308
  unsure (1)..(309): n = a or c or g or t
tgatagcacattttagtttttaataaaatctgctttttacttatatttaaataaattgcccagttactgaatcagaagcatttcttacaaagcaaacaaaataagcatcccttctatgttaataacatgttaatagtatgttggcaagttgatttagaacaacttgccaacaatacaaacagaaaaaaggagtgggtcaaagaaatctagtttggctttattttcaatagatcatactgtctgttgaaaaaggaataaataattatggagcctatctaataatatactcaatagnttgaaattattgag

SEQ ID NO: 546 - DNA, 277 bp, Homo sapiens
  Genbank Accession No. H03387
  unsure (1)..(277): n = a or c or g or t
acgcaagttagannanttattatgataactctgcaatcttttcagccactctttaaggttcctgggcatccattctgggcacagtgtgacatttacctgaacagagaggagantggcactagaagatgagggagatttggtgcctaaaaattactacaaacaggcagggtgcagtggctcacgcatgtaatcccagcactttgggaggccgaggtgggtgcatcacgaggtcaggagtttgagatctgcctggccaacatggtgaaaccccatctct

SEQ ID NO: 547 - DNA, 372 bp, Homo sapiens
  Genbank Accession No. H05084
  unsure (1)..(372): n = a or c or g or t
ttttttttttttcacagtgagcattaaattattattccatacagccctggccctggcccttcttgagggagtggggtttntggggtntgcccagcagggatcctgccagatgatgtccacatgagaaggcaggtgtccaacagcttcagcttcacccagtgccccccagacaaataatgacaagtccagggtcttctgatgtgtcaggccagcactccccttgctgatgggaaaaccggggctcggccagccccactgcatcccctcacatgatgatacgaggctctngcactgactcgccaatagacttgtggggcagcangctggctccgttgaggtaggagctcatcattaactattgacgtcctncac

SEQ ID NO: 548 - DNA, 353 bp, Homo sapiens
  Genbank Accession No. H05625
  unsure (1)..(353): n = a or c or g or t
ttttttttttttttttttttgcttcacaaatgtcaattttattgacactagtgcacaactaaatacaataattgcaaaggaagtggaacgtgttcaaacagaaatggtgacaatgagttagaactgcagttntttcaaggtactacactattatttaaaaaaaaaatcacaaanagaaaaatgttatcactacaagtagggatttaggaagngagnaaattctgggcagtctgtctagnagggttaaaacatttcatggcatttgtgagttgctgttggagagttgttttttatttgtccaccgtaatctgggcaacatccgggggcttaccttcagctctcggcactgtgcg

SEQ ID NO: 549 - DNA, 501 bp, Homo sapiens
  Genbank Accession No. H05704
  unsure (1)..(501): n = a or c or g or t
tttttttttccttctgtagtcgtctttatttagagcagaattcagactcagctggtatcccccagggcaaccccaggatgggganagggctggtctgtccccacccacttctccaggatcctcccagcccccaggctgncttttccctccaactgtcagctgcttagctgctcatctggggattggagctggagcatctgtcaaggttgtctccttgacaaacagcttcctctttggaaatggcttcactcaggtcctgcaggtcatcgagcaggacagagagggacccggggaaggaagacagcagatgagcaccagacaagggaaggtgctcgtggttacagagggaaacagggttgggcacagggaaatgagggaatggggagagagggaggctctttgggtccaagctggggcatcncttaaaagaggtttaagggtntcgaaggaccncagagaacaacattcttcntgcgagatttttaagagggagttttctna

SEQ ID NO: 550 - DNA, 465 bp, Homo sapiens
  Genbank Accession No. H08548
  unsure (1)..(465): n = a or c or g or t
ttttttttcacaaatattggcttggtttttatttctatgcttataaaaaaaatatgaagcttctttgtgtggactgaaggggtgttagcctgtggatgttggtcttcggtgcctgtaccccagtggctgtttacattccaggnccctgctaaataaagnaggctccactgccagctgtctgtacactttttcttgggggaagagttcttgtcttcagtttactgcagtagggttcctggctctgttacatgctcatgtgttccggaagaacatatgaaatatcatcccacggatgacgatacagcccctgcttcagcctnttctgatcaagatagtntccaatgaaccccatactccttcccagcacaaagatgccattgagggctccaatgtcaatattattgcatcagcttcctcccgagtaaagggacccacagttttttaaggatgttttacaattgcgat

SEQ ID NO: 551 - DNA, 396 bp, Homo sapiens
  Genbank Accession No. H09077
  unsure (1)..(396): n = a or c or g or t
ttttttttttncaggaaataatatttntaatacaagtgttcaggctttcaatagttaactatttaatatttatatagattgaggtgactaaagaatgtgttcaccaaaaaaggcctaaattcattaagacagtctctgtgaaaaagggatgttaaaggttatgagaaaagttactagatctgcatttttaaaataaaaatgactttctgagatattgggacagaaggcagctttagttatttgggaggtcgaggcatacatgtctactatgattcaccataaagccatattaggcaggccattggcccaggtacatttcggcattatttccttttgcatatttcatatggataaattccttttaaggtttgaggcaccaataaaaaattagggcat

SEQ ID NO: 552 - DNA, 365 bp, Homo sapiens
  Genbank Accession No. H11463
  unsure (1)..(365): n = a or c or g or t
tttttttttttttttgcaaccatttatatacagtgttacataacagctctggagtacagtacatgcagcagaatatacctgttgaatataaaatactttccttaaaatcttcatcattggaattccttgaagtctaaatcatagaatgcccattactttgagaaaatggttgaggagtacaaatgtctgcatatgttggccactgaaataatccaaggctaactgggaataatattcataggcacaccgggggtgcataantnntttacttacattattaaaatacaacccataaaattcaagttcaggatcttatagggattgtctatggtaaatcctttaggtggttgccggggaaatggcat

SEQ ID NO: 553 - DNA, 386 bp, Homo sapiens
  Genbank Accession No. H14810
  unsure (1)..(386): n = a or c or g or t
cataaaaacattttattcacaaaattggtcatcacagcattatttacaatactgnaaatctggaaatagcctaaatttctaacaattgaaagaaggttaagtaaattataagactacacaataaaatatattaccagcaatatatctttgtgaaaatctataataaccacacataatacttagtaaaaaagcancataaattacatgataaagcactatgaccagnancaatgncaaaaaattcacacccccaaaaaagnacaaggatattatatgggcaattttgtgggtaaaatattacatgttatttgtgnctggcatttctaattttccccgttaactggacacatncggttttcntaattagggggaaanaaaattacctt

SEQ ID NO: 554 - DNA, 313 bp, Homo sapiens
  Genbank Accession No. H15143
tttttttttttgtgggtcacagttgagggtttattgccagtgttaggaagaatggggggtctgggtggccaggggtcttgggaggaattccaaatgagcactgcagggcctgtgagtggggaggagagctgctgcccccctgccacccaggaggccccagggctgatgccaccatatcctgactgctagtggtgccttaaaaggtggcctccccacaggaggggagccttgggggcccccaggagtcagccctcaccaacaagccctctctcaagggggccaggggcttttattcctcatgggacaggctggg

SEQ ID NO: 555 - DNA, 295 bp, Homo sapiens
  Genbank Accession No. H16171
  unsure (1)..(295): n = a or c or g or t
tttttttttttttttttaaattaaacacccntatgantttattaaatccagaactgtgttaaagggcggcggtctncgagggggagtntggtagggggacgagggacaagatgatgaacggccgtgggcatcccntagggngacccggnccacccccgcccaacccaccccctcngcaacgctgcatcagcttcaccatgattcccagtggtgctgggctgggcagggcgagatggctgggaaacacagagggacagagggacagacagacgccttccacaaacaaaccctggnc

SEQ ID NO: 556 - DNA, 389 bp, Homo sapiens
  Genbank Accession No. H16676
tttttttttagttttgtggtactacatatgttttattaaaaattcaaactttttttcagatcgaagcataatttatcttccattaacaaaaacgaagatcttaaatttgacacgattacaattaaaatgctgaaaggagttatgaggcatttaaatcattcttcaattagaatgtttgcagcatatttctcagaggctgacctggaacacattacctttgttggcaggcatcaaaggcaggataaatcctgtggctggaaatcaattgtgagtcccattaggatgactttctaggcacacatgcatagggtcttgcactgtatccgttctacttctaggaaggttgctgtctggaaggctctttcccctgggcgaggtcactttcccgg

SEQ ID NO: 557 - DNA, 471 bp, Homo sapiens
  Genbank Accession No. H16768
  unsure (1)..(471): n = a or c or g or t
tttttttttaatttataaaaatgaaaagtttatttgtctcatggttctgacaggctgtacaagaaacatggcaccaacatctatttctggtgagggctttaggctgcttccactcatggtagaaggcaaaaaggagctggcatgtgcagagatcacgtagncaagagaggatacaaggagatttccaggnctctttttaacagtcagctctcatgagaagtaatagaggaagnaagtcacttactactgagagagtggctccaagccattncataaggaatcaaccaccatgacacactagggcctcacctccaaaactggggaatcacatttcaacatgaggatttgggaagggtcaaatatccaaactataggcattctacccctggaacgcctaagtatcctgtccttctcacaaggcaaattacattattttattcccattagtttcccgaaaacttaacttgtttt

SEQ ID NO: 558 - DNA, 354 bp, Homo sapiens
  Genbank Accession No. H17333
  unsure (1)..(354): n = a or c or g or t
tttttttttaattgttaatattgctaatttgtacaatggttaatgatcttataaaatagttgtatgaaagcaccaaccaccttagaaagtctgaccagcattcatatctactttccagaccctcatccctcctccccactcacctgactctgctcggctcattcatgggctttcctgtgctctgccattgctcaggtgagtgagcagttcgcccggcacattgaccaggcagatccagggcanccgatcggtggagcccaggaaatggagaggctggcacagctgcagcaatgcctgnaagctgtcctgattttctccggcttngagatagccaccacttttgagcattattac

SEQ ID NO: 559 - DNA, 486 bp, Homo sapiens
  Genbank Accession No. H17550
  unsure (1)..(486): n = a or c or g or t
ttttttttatttttaaaaatctatttatttatcaaaacagtattggcacagtaattctcatattatcatcaaataataaaattgctactttctgtactcaattctttagaatcctagaaattgcaaatgcattcaatttaacaatattgtaaataacaatacaaaagaaagaactctgcatatttatggaaacattgttgatggtacagttctactgaaactcatacacatttcactatttaatttacatatggncttgttgaaaaaaaccagtatgttttactttttcaatttccttatggctaaaatacatgtaattctaaagggatatctcttgggtgttataaaaaccagggagggtccaccaccaggtcaaggttggngtcaaggntacttcaaaggttccctggaatggatccggaaaacaaattttaacccnaaaatgtggtaccgntttgggggggcccttcncgggccccccaacgg

SEQ ID NO: 560 - DNA, 477 bp, Homo sapiens
  Genbank Accession No. H18099
  unsure (1)..(477): n = a or c or g or t
aaatagtgcaatcaaaacctttattaattttnctcattaaactgaaatgataaaccaaatgaatgagaaaagtggcagtaaaagatttagcatgaagtattatttctcaggtaatgtcaagaatattatgaaaatatatacttgcttataactgaatcaaagaaaatgaatgcatttacctttgaaaagcagaggtactgattgccttcaagcttcgggttataggaccttaggctgggagctgatggccccacatagctgatcttctggttttgtaatgagagaaaatgggaagagtctctctgggaaggaaaacttagggtcatttatctctcaagctttatctattccntaatgtatatgggaacactaatagttctgcctatctttctttgccagagtaggaaaacaggttccaaaataaatagtcncgaattatcataaaggcntaatagggtggggtttttaaattatatt

SEQ ID NO: 561 - DNA, 371 bp, Homo sapiens
  Genbank Accession No. H18947
  unsure (1)..(371): n = a or c or g or t
ttttttttttctttttttaggnttcatgtttgttttatttaaagtctggttgggtacagaaaacacacacacacttaacaggttaaaatatccaaataaaatttactgcaacttttgtagaattttatttgtgctacaagacacgttgcataagaaactatttaaagcccctgaggaaaaaatatccatggtttaaggtgcaactggttttgtttcttctttggggaaaaggtgatagatggtctctgggagaaattatggggtggagttgagaagcacaatcgaaggttatatggtgggatgattggcgaattgtgtgtcctgggttcttggcagcattaaaatagcctaatgttttgttctttttttca

SEQ ID NO: 562 - DNA, 478 bp, Homo sapiens
  Genbank Accession No. H19969
  unsure (1)..(478): n = a or c or g or t
tctaaatattcagatgtgttaattacatgccctagaagctggaagantcagtggtgttcacactggacgtggagctgtttgtataattttcatctccctgcacttaaacatgactctcagtctaataaattcaaccttgtcatttttagaatctacgggatttctctggctgtcgtttgcgctgcatttatccgaatacatccagctcgcaggcatcctgcaagaaacggctcccggctcgcgtgtacgccgacacctcggcccaacgcaggactcgaggtggtttctagtgcccgggtggctgcaagtctgccctccgagggaggctgggacaagcggcgcccccagggtcgagcggcctcttcgttgcctnggcagtggctgggnaggcncccaccngttgccagttgttttcgggaaacccgcttggccaagtttcgcccggggtgaaaaatgaaagcaatttccccaacagatt

SEQ ID NO: 563 - DNA, 187 bp, Homo sapiens
  Genbank Accession No. H21814
  unsure (1)..(187): n = a or c or g or t
ttattgagggtttattgagtgcagggagaagggtcttgatgccttggggtgggaggagagacccctccccgggatcctgcagtctctagtctcccgtggtggggggtgagggatgagaacccatgaacattctgtaggggccactntcttctccacggtgctcccttcatgtcgtgacctgggcagc

SEQ ID NO: 564 - DNA, 432 bp, Homo sapiens
  Genbank Accession No. H22453
  unsure (1)..(432): n = a or c or g or t
ttctcttgttgctggagttgtaaaaatcaatgtcccattgctgagatcgaagctccctgtgtctctggggggctcagcagggacgatggcctccagagtggacctctgagaaattgcagaggcatcagagctgtgggctcagcatatgaggtccccaggggccatagaccccctcctcctgggaagagtgctcctgcagagcttatttgcaatctcctgggagtcccagactcaccaaaggattcagatcctcttctttttgcctcctacatagagcacattatagacctgaaacaggaatcagaattccagactcccttagtgaggagacaaagtgttaggtcttagctttttcccttctaaattaagggtcctccctgggattcaggttgcctgatagcttatncctgaaantggtnggagatagggaaa

SEQ ID NO: 565 - DNA, 214 bp, Homo sapiens
  Genbank Accession No. H23407
  unsure (1)..(214): n = a or c or g or t
tttttttttttttctaggggagaagattttatttcacaaggtgaggaacccaggctggtggccgacgcccacacaccaggntccgggacgcatggggtctgcacgtggagagggtgctggccgccccagcaggaagcccgacgtaggtcccagcgtntctgtcagtcatgctgctgccctgtggcttgggagaggcaggacgtgcacccagcct

SEQ ID NO: 566 - DNA, 697 bp, Homo sapiens
  Genbank Accession No. H23520
  unsure (1)..(688): n = a or c or g or t
ataatattaatgnaaattcaaatgatatncatggaataaaaaataaaaagatttctcaaaagatcagntaaaggnacaaatgaaggcaggaagaaaaaatcaaatgtgtaatccactgtgggatcttaatatcaagattcaaatatgtaaaatgattgcttttaattttgaatatgagttttgtaatgtagaagttaagagagttttatggagctataaagaatgcagtgagttgacaaccattttccttagtatttttccccaagaaaataagtgtgaaacccgttgataagncataccacatgtataaatgactattctagattcctctctctctccttctgttcctttcttctgtctttctccctccctccttctcttcctttctttcttccttttctctctccctctctccccttctccctctccttctctgtctttctccacccctcccatgactttttcttttttttttaaatatacttaagcttnggggacatgtgcacaacatgcaggttgtacaatgtancatgtgccgtgtggtgtgctgcatgcattaactcggcatttccatagggataccccnatgcatcctcccccaccaccacccacagangcccgggtgtaagtcccntccgggncggggtncactggtcaatccnccatgggtggcatntgggttggttttgcctgaaaa

SEQ ID NO: 567 - DNA, 233 bp, Homo sapiens
  Genbank Accession No. H26288
aaaaacaccagtttgaaacacattactgaaagtgagtgtacacaataaatagaaaatagggatgcatagtgctggagacattcaaccaacttatcttcatctgttgcctactgttgtagacaaaatttgacacacaattagcattactgaaagagcagccaaactacctcggagaaagtgggcaaactactggaaaagtagcttaaagctctgggaccactcaccaaaaataa

SEQ ID NO: 568 - DNA, 290 bp, Homo sapiens
  Genbank Accession No. H27180
  unsure (1)..(290): n = a or c or g or t
aggntttattttggaccaaaaaaaaaaccacaattgttttctagctggaagantgggcaaggggggtcccagacagtaaactcccccacgggtgggttgagcctcaggtggggggtctcctgttgtctgtgcttccccacacagcagcctccctcctggngtctgtggcagccacgggaggggcagactaggaggagctgccacagttnttcacttgggcaggaagtcagaggactcagacaccagcttcccatcgcgggtntcgatcttcttnanaaccacggccctgg

SEQ ID NO: 569 - DNA, 292 bp, Homo sapiens
  Genbank Accession No. H27675
  unsure (1)..(292): n = a or c or g or t
gtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaaggntcccgccagcctcctggcatctgagctggtacagtggcacatgcantcgaaggagaagcgcagggccatcgaggccaggaagaagaagatggagg

SEQ ID NO: 570 - DNA, 116 bp, Homo sapiens
  Genbank Accession No. H38418
agctgagcattttttatgtgctaggcactgttccagtgctcggggacgcagctgtgaatgaacagaaacgggggatggaggacaggggagaaacccccttcacgggtctttgggcc

SEQ ID NO: 571 - DNA, 212 bp, Homo sapiens
  Genbank Accession No. H38995
  unsure (1)..(212): n = a or c or g or t
tattactgncttaatggggnccaaaggggcaacacaaaggcattgaaaacatcactggctcacaaaaacagtcaccttgttaccttctcagttgcatttgtttatttcacaaggcttcattcacacataaaaacaagatactaatccaatncaggtcnnaacgattataaaagtaaacatttnttggggcatgtacaataaattgcnctttt

SEQ ID NO: 572 - DNA, 327 bp, Homo sapiens
  Genbank Accession No. H40424
  unsure (1)..(327): n = a or c or g or t
ctgtatantttnncttnttttttctcttgtgatttggcacttaaggcttaagcgcnaaaaaaaaaggcatctactgacaaaatatgggacttgtctgtnatgcatggtaagtgggctataaaatccagggagggggtttcaagccagaagaagctactgacaaattgacttgtccttatgttaggtggggttatgagggggagagggagggcacattctgaggtgctgggggaaaggggttgagcttaaccttgttaatgtagggcctgtggggaatgggatgggtagggagaagagggtatgggatgtgggtgcagggtaggggct

SEQ ID NO: 573 - DNA, 448 bp, Homo sapiens
  Genbank Accession No. H44631
  unsure (1)..(448): n = a or c or g or t
actcagcatncnttttattttnctatctgacatttctaacaaaacgccagggagacggagttaaaaagaatccaccccacgaaaggtaaacaaaggagaccctcagaaactccctggcaaggatgttcccctccccagattgggcccagtttcaccagcaactgggtctcagactcagccttatgcctttccactgacaccccccacccctccacantctcgtgattcagaccagggaacttctcgggctgattgtgtccgtgtgtctgagggaggggcacgctggaacctgggaacctactgggcacctctaatgcagatgagaaaaacttgagaatgtgaaaggagatcagtccccgntcccacccgaaggtgcagagacgcgggacattaaccagcagnacgcgggggtgaaggaactcagggcaatttctcccantgccagggg

SEQ ID NO: 574 - DNA, 339 bp, Homo sapiens
  Genbank Accession No. H45265
  unsure (1)..(339): n = a or c or g or t
nannttttataaatnataatttaataaaataaaaataggngcacaaatattggcatacagtaggtncccaataaaaggtggtggatacacagtaggttttcagtaaaggatgatgggcagggcatgcagtagggcagccactcactgtccctgcacctggcctccacccctgggctcacctcaccagggggaatccccagggcacaagcggtcaacagctggcatcctctgcccacggtntaccttggtcaagttcctcagcaccaacacatccccctgggtggctccttgggaccacccgttcccnttcacggtcttacatcctcgtcctcctttccc

SEQ ID NO: 575 - DNA, 368 bp, Homo sapiens
  Genbank Accession No. H48263
  unsure (1)..(368): n = a or c or g or t
cacatcagttaatnntannaagactcacctgatcacatcaacagatgcagaaaaggcatttaataaaatccaacacctgttcatttcaaaaaacactcagaaaactaggaacagtaagaagcttcctcaacttgataaacaacatatatcaaaaacctacaactatcatcataattgatggtcagaaattaaagctttcccactaagatcaggaagcgggcaaagatgttccctctcatcatccttttccatcatatcatactgggaagtcctaggctaattcaataaggaaaaggganataaaaaggtatacaggattgggaaggcataaaataaaactggtctttgttgacaggncaacatggtgg

SEQ ID NO: 576 - DNA, 387 bp, Homo sapiens
  Genbank Accession No. H48475
  unsure (1)..(387): n = a or c or g or t
nnnttacgtttgcaacatttaatgtgaaattagttncatactgtttcctgaagatgctgatggtgtaggtcaaatgaaacatcatagaagaggcagtatatgtatatcctttagtatatcttttaccttcagaaacttttttttggagacagagtgttgtcctggctaaataaagtgcagtggccganncctgggctcactgcaacctccgcctcgtaggttgaagtggaggttgaagtgggccaagactggtatactgcactccagcctggggntaacagagactccgcctcaaaaacaaacaaaaaaactaactggtaatttaaaaactaaagtttacagttgggctccaatgtatctcaaagtccaaactgggccgggggccag

SEQ ID NO: 577 - DNA, 346 bp, Homo sapiens
  Genbank Accession No. H48793
  unsure (1)..(346): n = a or c or g or t
gatttaggagattccaagtgatacctttaattcactactctatgtccttattaataaatacatatttaaaaaaacctatacaatatagtgtatttacagcatggaagagcagagactctgaagccagactgcctgagttcaaatcctgacacttctactcaaatatgtgtgagtgactttgggcaatttacttactctttctgtgtttctatttactcgtctacaacaataatttctacctcatcaaattaaattaaaaaaaaaacggcttaaataggttaacatttgtaaataggcttaggaaaacactacatttaaaaaaataancattcctaacccaccttcc

SEQ ID NO: 578 - DNA, 458 bp, Homo sapiens
  Genbank Accession No. H49440
  unsure (1)..(458): n = a or c or g or t
ggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttggggaaggggctttttcagacagactgtttgctttctgctgagattaaggaattgcatcantctgccagagtattgactttttaacagattattaaataaagg

SEQ ID NO: 579 - DNA, 446 bp, Homo sapiens
  Genbank Accession No. H52835
  unsure (1)..(446): n = a or c or g or t
cggataccctgggggcctctgctcctctctttgtggagacgtcgtttcaccggcggcgcgtgaccccggcagctgtccagagacccagagatgtccaatcacaggcgcacggtgcacaggcgcgcagggctgcctggaacgggcccaggcaggcagtgaccgggacctctccggagggagaggaacggtgccctcccgggaggagctggccaggcaggcgctgcccagggcggccttccctgctggactacggcattgcnactgagttatataaagacactatttggggaaggacagcgggtgaggactnggcgcggcggcacacgctttgcctgttgtnttcagctcttctgggggccaaggcagggagttccagggtttacagtgagcctgatngccaattgctttccaaaagagagaaacagagagaaagggattnaggcttc

SEQ ID NO: 580 - DNA, 386 bp, Homo sapiens
  Genbank Accession No. H54764
  unsure (1)..(386): n = a or c or g or t
gatggagtttcgctcttcttgcccaggctggagtgcaatggtgcaatctcggctcactgcaacctccacctcctgagtttgagattctcctgcctcagcctcccactgggattacaggcgcctgccaccacgcccagctaattattgcatttttagtagagatggggtttcaccatgaaaatttttatttttattaaaagagtgcatgagttagtcatgaaggcagagccagggcggcctgcataccaaatgtgaaggaacagtaccaattgacaaaggaaggcacaaaactaggacaaaggaaaagggacttcaattaaataaggtaatttggaactaactggaaaattgaggagggggaaatngcaaataaaatnggggaggca

SEQ ID NO: 581 - DNA, 384 bp, Homo sapiens
  Genbank Accession No. H56673
  unsure (1)..(384): n = a or c or g or t
gttaccaagacacaattttaagatcaaacaagtgtcaaggtaggccatggcttgttggcagtagtaggggccctatggctatttccaggtatgggtggccccttttccttggttatctggggaatctgccacagcagacagcaaaaggtaaaaagcatccctttaataactacaccccactccagcaattgaggtttattcaggggtgggtcaaagtagtacaagacaaaaatagcttagtgaaatggnttagaatccagactgaggtgccagactgcctgcatctgaggtctcaggtcccaccatgtatggaggccgtgtggaccttgggggtgaggttactaggcctccccggggtttcaaatcttcttcacctgtaaaatg

SEQ ID NO: 582 - DNA, 405 bp, Homo sapiens
  Genbank Accession No. H58781
  unsure (1)..(405): n = a or c or g or t
ctcttgtagcccaggctggagttgactggcattgatgtgggacgcggggagtgaacaagcaaacactggggctgtaggagtgaagagaaaggaatcaaaggaaggaaattcccatcccccagaacaaaggagaaacatgctcttgtgatgagcacgcataggatgaggctgcacctatgtcaggaaaaagccgttctgcngaaggcccatcagagacagacttgactctggacacctagccccacaaacattgtctgctccaacacatatccagttttccccataattttatgtaaactactcagggtatactctcattcttacttggaaactaaatttgtatggntatggcctgtggtactctaggaaggtttctctaaagaggggagggatttaaataaaacc

SEQ ID NO: 583 - DNA, 440 bp, Homo sapiens
  Genbank Accession No. H58873
  unsure (1)..(440): n = a or c or g or t
actataacttagtgtctgtatttaatattgacaaccaaaaatatatatanttttnttgcatctatacacaacagggcaggagtctccatgtnttcttgagcagtgagtttgcaggctcccacaggccctcttctcatggtaatagtgtggccctagtgcaaaggagactagaacccggcagcccagactggcccttcccctctcctccctgcactccagtgcttcccaactggtctcaggtaaagaaagnttantttgagtggttgggtaggaagagatgggaaggggcaaatcctaatgggagcctgacccctagagtggggagttccagggccagcagaacgggtgggccatagccctncctggggntagaagctttgtagttcatagttcgattagtntgtccntagggcatnaggtnccagccctacagattagct

SEQ ID NO: 584 - DNA, 414 bp, Homo sapiens
  Genbank Accession No. H59141
  unsure (1)..(414): n = a or c or g or t
aatanaggaataataaattgatttaataatttgaaagaactgtaaggtttaggttttgttcttatttttagtgcgactgagattggagtctgtttgtagacatatctgaaaaaagtgaagggggagatggaagatggtaaatgccaaggaaaagatggaaggataaatcagtgtaataaaaaggagcacttctttttcgccaacagaagtaaaggtaaaggttaagtgtctgagttaacgaatggattgttgacctctggggagggtgctcccatcagctcagctttgtgacgacctaaggaatatcccttccacacctttcctgatccaatcgttctgggctgcataaaaccacctaaatcaatcaactgttacacttcccttagtgctaggggcatattcctnataactccc

SEQ ID NO: 585 - DNA, 284 bp, Homo sapiens
  Genbank Accession No. H60595
aagacagagtggactgttacaaatgattttgcaaaatacaaaaatagatatacttccactgaatgctttaatcatttttccgggcactctcatcttttggttcttcctcatctgagtacacagtgggctcctccccctccttcagcagtttgcccacgtgatgatacttgaaagtgaactgagactcccagtcactcagagtctcctgctgggcgcagtgaggtcagaaaggtcatcgtactcatccttcagtgcttccttatccggggaaaatgtgggcaagg

SEQ ID NO: 586 - DNA, 317 bp, Homo sapiens
  Genbank Accession No. H61295
gaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaa

SEQ ID NO: 587 - DNA, 462 bp, Homo sapiens
  Genbank Accession No. H61361
  unsure (1)..(462): n = a or c or g or t
gctggggcttagctgggaggtggtctgaagcagacagggaatgggagaggnggatgggaagtagacagtggctggtatggctctgaggctccctggggcctgctcaagctcctcctgctccttgctgttttctgatgatttgggggcttgggagtccctttgtcctcatctgagactgaaatgtggggatccaggatggccttccttcctcttacccttcctccctcagcctgcaacctctatcctggaacctgtcctccctttctccccaactatgcatctgttgtctgctcctctgcaaaggccagccagcttnggagcagcagagaaataaacagcatttctgatgaaaaaaaaaaaaaaaaaaaccgcggccgaaagcttattnccctttaagtaaggggttaatttttagcttgggcactnggccntcgttttanaacgtcgtgaattnggaaaacc

SEQ ID NO: 588 - DNA, 512 bp, Homo sapiens
  Genbank Accession No. H63994
  unsure (1)..(512): n = a or c or g or t
ccctccaaggttcacatgttggaatgtaaaccccaaggtgatggtattaagaggtagggacttcaggaggtgattaggccatgggggatctgcattcgtgaatgggataaatatccttataaaacaggcttcagagagctgcttggtccttgcacctcttctctcttctaccacgtgagaacatagcatctgtcacctccagaagaagcagcaacagacatggtcttggaagcagagagcaagtcctcaccagacaccaaatctgtcagaaccttaatcttggacttcccagcctcaaaaactgtgagaagtaggtttctgttattatatatcacccagtctcaagtattttgcaatagcaacagggaataggactaaggacaatgagttttgcacaatctaacttttaaaacctccnggtaaggcaaagcttgagttttattttcatggatttaaaagggncaagtaagggattttctcggttnaccggccttattggggtcnggtattac

SEQ ID NO: 589 - DNA, 280 bp, Homo sapiens
  Genbank Accession No. H64411
  unsure (1)..(280): n = a or c or g or t
tctgcttgaagaagggagcaggcaagggcacagatgcaggtggccccatgctgctaaagacaggctggaaggtcggggctgtggtgctggtggtcgtggggagggaggagctggagggcgctgtggctgagactgaagggccaggcggtgtgaggccttccttctcactcttgggtggagccgtgaaaatgggcttgaacatgggagatgctgaagatgcagcaggggcggcagggctggaaggtnaggtnttctgtgttccaaacaggaagctttgctt

SEQ ID NO: 590 - DNA, 370 bp, Homo sapiens
  Genbank Accession No. H64493
  unsure (1)..(370): n = a or c or g or t
gggtgctttatttccatgctgggcgcccgggaagtatgtacacggggtacgtgccaagcatcctcgcgcgaccccgagagcccggggagcgggngcttgccggccgtcgcactcatttacccggagacagggagaggctcttctgcgtgaagcggttgtgcagagcctcatgcatcacggagcatgagaagatgttcccctgctgccacctgctcttgtccacggtgagcttgctgtagaggaagaaggagccgtcggagtncagcatggggaggcntgggtnttgtagttnttctccggctgcccgctgctttcccantccacgggcgatgtcgctgggggtagaagcctttgaacagggaagtcaggc

SEQ ID NO: 591 - DNA, 460 bp, Homo sapiens
  Genbank Accession No. H66642
  unsure (1)..(460): n = a or c or g or t
ttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccggggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagcttctttaggcattaaggagggaaaatgtttaataaaatgtaattaaactgggatggaatggtcagtgtatttaaatgtaaatatacttaaatgtaattaccggggnggt

SEQ ID NO: 592 - DNA, 291 bp, Homo sapiens
  Genbank Accession No. H68097
  unsure (1)..(291): n = a or c or g or t
tgaagtttatttnctctggcagtatgttttagtttcttgtttttnattttgttgtgtgtgtatgtgttgtagattttatgatttgaggttaccatgaggcttgcaaataacataacatgttattttaaagtgacaacttgacactgattgcaaaaacaaacagggcgaagagaactaataaaaactgtacactttaacttcattcctcctgtttttnaaggtttttatgggtttctatttatatctccttgtactattttgaaaagggnattgcaggttatcatttgttca

SEQ ID NO: 593 - DNA, 274 bp, Homo sapiens
  Genbank Accession No. H77531
  unsure (1)..(274): n = a or c or g or t
ggtattcaatgcgtgttcatttatttnacacttacaaaagaaatcgcccacccctttgccncattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatnttacaagttagcaaattctaggtac

SEQ ID NO: 594 - DNA, 317 bp, Homo sapiens
  Genbank Accession No. H77597
  unsure (1)..(317): n = a or c or g or t
tcaagtctaagtgtttaattattattcacatatttcacagaaaaaaaggaatgtagcaaatgagtcggagttgtagaaaaaaaaaatcctggnttttacgtgtcattctgttttcatctgacagcagggctgtcccgacatcaggcacagcagctgcacttctctgacgcccctttgcagatgcagccctgggcacacttgggcacagcccaggggnaaacaggagcagcagcctgggggaaaaagggagagagaaggtcacaggcagacttnaccagggganctccctttcccaacagcaggcctgggctcaagct

SEQ ID NO: 595 - DNA, 340 bp, Homo sapiens
  Genbank Accession No. H81070
  unsure (1)..(340): n = a or c or g or t
caggtctaaagtgtttaattatcactcacatatttcacaggaaaaggaatgtagcaaatgggtcaaggtggtataaaaaaaaaatccaggtttgtacatgtctctctgtttacatctgggagaaaggttgtcctgggcatcagtcgcagcagctgcacttctctgacgcccctttgcaaacacagccctggggcacacttgctacagcccacgggnagncagggagcaggcagctctttcttgcaggagggtgcatttgcctctttgcacttgcgggaaccagcgcggtgcagggaggacaccagcggcgcagggagcagttggggggtccattngcaag

SEQ ID NO: 596 - DNA, 330 bp, Homo sapiens
  Genbank Accession No. H81379
  unsure (1)..(330): n = a or c or g or t
ttaannttttttaaaaccaaaagaacaactttaataagcttttacggcactgcaattacaggaacatcgacccataacatgcaacaaaaatgattttgccttttggacatatttaacagataaacttgacattacaagtaacagcaacacattcccattctactgaagaaaacaaatgcgatttaactttcaggttagaaaacgtatcttcttactgcaatctcaagtnggcatttngaaagtttagttttcccttttctaacctctaaaagatgatatgatttttaatgcaatcatacacaactgttttcacattggggaatantcacg

SEQ ID NO: 597 - DNA, 419 bp, Homo sapiens
  Genbank Accession No. H81413
  unsure (1)..(419): n = a or c or g or t
ngagccagaaaaggattttttttaattcaagtaactgaaataggaaaccagagggggagccccaggctgggataaatcatggctacccctccccaacagaacagggggaggaggtggcccctacacccattatggtcgattcgggcccccttgctcactctgctgcagcatcctagaggcagggccccaccttccctgggactggggtagtcggtcacccagcctgcattgccccagcccctnttccccacaaagagtatcttgggggagggnttcgtggggcagaacaggagggcaatgagggatgaacattgctcaaactcctttcaaaggggcacctgaccgcacaggggaggntgggcaggaagggcaagggntgggggatgccgtntaaggagggcggangcaggcanttttgg

SEQ ID NO: 598 - DNA, 386 bp, Homo sapiens
  Genbank Accession No. H83380
  unsure (1)..(386): n = a or c or g or t
ttaattgcagaaaaatttattaaattggaaaatcttgcgtttttcaatggcgctggccccgggtcagcggcgattttctctgcatcaagatgggctttgcgtttccgtagtgggcaccagtggtggcctgattgtcagtcttctcccggcatttttaaggccagggagccgaagcgctgcttgtaggcgaataccctacagagcggtttggctttttaaattactgttattattttgggcagagaacagtcggtctgggtgcaccccgtcctcgctgcagaagaggctgcgagtccgaggtggggtctctcgggaaggtgaaattccttctnggggntnagcgagccccggccccgcgcggcagtccagcggccccggtgttgttg

SEQ ID NO: 599 - DNA, 335 bp, Homo sapiens
  Genbank Accession No. H84761
  unsure (1)..(335): n = a or c or g or t
cggcactttattagtggggaaacncgccntggnctggcagagactgggatcaacaggaccngcacccatctcgaggnggtattttcngtaagancaggngttccnccctcgtaggtttagaggaaacaccctcatagatgaaaacccccccgagacagcagcactgcaactgccaagcagccggggtaggaggggcgccctaggcacagctgggcccttgagacagcagggcttcgatgtcaggctcgatgtcaatggtctggaagcggcggctgtacctgcgtaggggcacaccgtcagggacccaccaggggactttcttcaaagttccnggg

SEQ ID NO: 600 - DNA, 178 bp, Homo sapiens
  Genbank Accession No. H86112
  unsure (1)..(178): n = a or c or g or t
gcttaatggggccaaaggggcaacacaaagcattgaaaacatcactggctcacaaaaccagtcaccttgttaccttctcagttgcatttgtttatttcacaaggcttcattcacacataaaancaagatactantccaattcangttcataacggttataanggtaancatttgttgg

SEQ ID NO: 601 - DNA, 287 bp, Homo sapiens
  Genbank Accession No. H88338
atgcatgtttaaacatttaatctagaacttgattacaaagtaatttaatgaagaaaataatctgttataattcttatagatgtttattagtttttagatttaaaaaaaaaacagggcttataattaaagcaattgactaatgatctcacagcctcaaggttgtatgcaaacctagattagaaatactttggtctctaaaaataacaaaatggaccataacattttttttcttacaagtttgaagtgggtcaattatgggggaaacacatacattcctaaggggaaat

SEQ ID NO: 602 - DNA, 337 bp, Homo sapiens
  Genbank Accession No. H88798
  unsure (1)..(337): n = a or c or g or t
nactttaataagtataaagtatataaacaattaggtaagcttgtggagaagctgaccaagatacataaattaggaaatacaagtgtccatctaaattttctatatttcatttttttcataatatttattaaaggtgtttaatatacagtttctcatctgtcattttggaagtcctttattgtaaagacaattctattgtctgatgacaaacagcagccaccatggttattcaggacctccacgttggataaattccatttcttcttgagacacaagtttccttctggtatttctgaggtaatggnttttattatttctggcagtgtctggtggaccc

SEQ ID NO: 603 - DNA, 321 bp, Homo sapiens
  Genbank Accession No. H91703
  unsure (1)..(321): n = a or c or g or t
ccataagacaagtgacatatccaaccaaccatccatccccacctgtgccctattctttccttgtgtttctttagagccttttcagctatttcctgtgaagcaaactgcacgaaggcctcccccgtactcctcccctggaagtccaccggcaatgttatcccatttggcacgatttccaacccttcaacccaaggacaaataaccccagtagggggncaatattaacatcacaagcccagnaaatgattcttcttataggctttaaataaaccaggactttttaactttagggtgaatgggtatgctttcaacaagtactct

SEQ ID NO: 604 - DNA, 395 bp, Homo sapiens
  Genbank Accession No. H94471
  unsure (1)..(395): n = a or c or g or t
tttgttacttttacatgatctttattatttaagaaaaacctcttttaaccatttatataacagaaaaaaaatagggaggctggtagatcatcacatatatagtagctaaaatatgaaaggccagggaatttattattaatgaagtcataaaacagacttaaccaaaagtgtgtgctaggaaacaagcagtttcacttcagagacttcattgcaggaacccagtttccttatgtggaaaaaagtgattataaataacagttatctgaaaggtggttgagaggattaaatgagatcacctatgcaaacaaatacatgtaggtatgaaagaccatccgtcctgggggtngtggaaagtttaagtttccccnccagaacccttccctttaagggcctta

SEQ ID NO: 605 - DNA, 373 bp, Homo sapiens
  Genbank Accession No. H94475
  unsure (1)..(373): n = a or c or g or t
tttttgcccattcattctttattcaggtggcataaaaatcactacaaaaaccttacaaaagagccttaaggagctcatgggatccttccctgcctcggttcctgagctcccgggcagaggagggagacaggagaggaaggaagggaaatgctggcagtgttgggatctcgaggagccgtgggaagtctggcgtgacaaggcacagggggtaggatggaggctgatggactctcggcaggttaggccacagccaaggctgtgccangacacgagttccacgcggggctgaggacaacgcttcgcctcccgagccaccaccagggcccgtctctccccaccctaagcctaggtgtcccgggacaagtccaaaggc

SEQ ID NO: 606 - DNA, 417 bp, Homo sapiens
  Genbank Accession No. H95960
  unsure (1)..(417): n = a or c or g or t
ttttattgttttagtaatcttaacataacttaaaataagagaggggaaatgacatctggagatctaggtatgtggcccattgcaattgagcacatttcttgggtctgtttctctatctctaagggcagtctcaaaaccccagctcaaaatacgacactaacatgatgaacatgcatgagctttgaaaagtgctctgtagtcttatgatgatctagaagagcactgtccaatagaactttctgtgatgatgaaaagattctacttctgacctattcaatagggtaaccactaatcatgcatggctctcaagcacttgaaatgttgctagtgtgattggggagctgcgttttgaatgttaacnaatttanattttaaatcnttaaaaagtttacatgtgggttagtgggncgccgtacg

SEQ ID NO: 607 - DNA, 439 bp, Homo sapiens
  Genbank Accession No. H97538
atttttgtagttttgggcaaaacattcactgttctgtttcagcatatttccttggaacatcttcatctctttccattttgcggacactccccttcttctattctcctttactcaaaacatatggtttagacccacatcatggctttcttgtgggaagcctggatgggactaggaaaacacatgtttccaacatggtgcatatctgtttgtgcagatatcagacaagatttaatcttgtctaacttatgcgtattgttttgatgtttgcctgtggttattctgggcacagcaatggtggacattattgaaaatgaactttattggcagatgaaagataatagaacatgaagatttatgaactaccataagctctgcatctctgggtcttcatttccaaagcagcacttggaaaaccaagcccagtttcaggcaaagagtt

SEQ ID NO: 608 - DNA, 543 bp, Homo sapiens
  Genbank Accession No. H97868
  unsure (1)..(543): n = a or c or g or t
cagcnagctgtgctttattgacaatgcggactggtatgtacgaggccgaattcgacttcagagaagcactggaggacggtggagaagaagaggttctcggactttctccgtgactaaggacatgcgaggttaaagttgtcttcttgagaacttcagaggtcagtccaggctttggatctgctgcagttgaactgggtaaattagaacctgatagttgagtggaatggggaaacagtaacgtcgaggaggtgcccttcgatgcagaaaagggtgtagagtgagcggtagtttgaaaatacgtagctgattcttccaccacggccccaccgacatccagcctcctagttgtggaactcctctaggacagaggctccctcgaggttaactgggtcgggtggtgtgttcggattagttggagaaacaaggagaaagcaggtggtttacaggcaagctgctcagaggtagtgggagaagaagttaactgcccatgcttttgctgaagggccatcccatgaagcattcaggatgtgatgaggtcttgag

SEQ ID NO: 609 - DNA, 317 bp, Homo sapiens
  Genbank Accession No. H97889
acattaaaacaaaaactttttattcacccagaactgggaatcacaattagtaaagaccataatagaattaacaaacagccctagaacacatatttaaatttgcagtgggtgttaagtaggaaaattatgactccatcaactcttccttggtaggttgatcttgcttttcctgaggcaccaggactcttcactgttatgtaaagaactgttaacctaaaagacatagaacagtgagtggccacctctaccagctgtgatcaagacctcccgggatccagaggatggtctaatagttcattaaattgctgtaggacact

SEQ ID NO: 610 - DNA, 495 bp, Homo sapiens
  Genbank Accession No. H98676
  unsure (1)..(495): n = a or c or g or t
tgctgggcatgtaaatgtgagggttacctgttttttttatcttcatacatccattcatcaattcagtcacacacttaagaactattaattaaatgcctaccctgtggcaggcactatattaagtgctgaggatacaatgaaagatatgactggtggttcttgaattcatctcactgtctactggagaagcctaacctataaacacagttacaactatgtgatgtggactgtaatggagaggtgcacacatgtaagcagtgatgggagcacagaggaggaagctcttattcctcctctgcaatggtgtggagtgttgtaagaggcctttcagaagagatgatatttgaacccagtcttggaagaatggagtatggggttttcntaggtggaactaagatgccaaaagatggtattccagggtantggggaagagcatgtgaatttnggtgaataaaggatgatagatgagtgaaagaatagccttaaggtaataaa

SEQ ID NO: 611 - DNA, 440 bp, Homo sapiens
  Genbank Accession No. H98835
  unsure (1)..(440): n = a or c or g or t
caagatcctgcctcccaagcctataagctttaccaggagagaggcaggccccaccccaagatccactatccactctttgaagaaagattagagccatgttctcagactttgggctgcatcctaatccctgcgaagtgcacaatgtgtgatgactccaccctccacccgatccagagggtctggggtgagacccaaggctgagaggcctcgatggcttcctggccccatctccggcagcagctctatggctgggctctcctgcaggctgggtgcaccccaggccctcagatggttctaaccagaatcgatgggcagcagtgacttcgactgtatcatcaatcttggctgccacaaggttgggttgtccaggccctcagcttganccttggaggtggggcccccacacagagctttgtctgcccccagcccaccctcattta

SEQ ID NO: 612 - DNA, 495 bp, Homo sapiens
  Genbank Accession No. H99035
  unsure (1)..(495): n = a or c or g or t
tgagctttggacaaatttattgaaacatacaggcggctgttagcagagaaatcattccatgattgatgtgttacatttggccactaccttgaatgtataatttaaaaattatatttttcacaactaagcctttgncaaaaaagtcatttagcacatctttaaagatcaataagaaatggattttggacattaaaaagatcaagtcactgaattaaacagtagcaacccccattaatctagaatcccatagtgctgaaggtagaggtgtctgtgcaaagctagtcatttgttaacagcaatcagaagangatgggggcaggcacacctgtcagaggtggcagcagactggcaggacaggacggctgggctggtctggtcaggtgagcatgtcccagagacagcagcaacagagagccgtccagcaggctgtgaggcaggtggatggtcctagctcatctcctccttgggtcttctaccacatacactgtgggnttt

SEQ ID NO: 613 - DNA, 424 bp, Homo sapiens
  Genbank Accession No. H99648
  unsure (1)..(424): n = a or c or g or t
ggggtatataattttattttaagtttatatttcctgcaggatagcaacatacatcttttcctacccagaggcaaaatacattttccaaaaacgtggacactgcccactgcattaagtttaaagtgctccctatatatatagacagtaaaagtaagcaaagaaacttacaacacattccaatctttaatatctcaaaaatgtttccaaggcaacattattaaaataattataccacagtccctaatataacatcaagctccagtaggaaggtacagagagggcaggaagtttccatccagtctggtttaggtgctcttcttttcttcacccagtaaattcacggtagctttcttcgcttctttagtgatggcatctgcagtccccttggccntgtctttaagggtccctgaccacactggtccat

SEQ ID NO: 614 - DNA, 438 bp, Homo sapiens
  Genbank Accession No. H99694
  unsure (1)..(438): n = a or c or g or t
attttnatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatatn

SEQ ID NO: 615 - DNA, 749 bp, Homo sapiens
  Genbank Accession No. J00073
taggtaagtggagaggttccattttaataatagaatatatctttaataatataaatgatgaaatagaggtgagttcatataacttgattggccatattatttcgtggtatgacatatcccacattatagcgaattaatatctaatggtttttctgtgaatcctcccaatgtgttatttgctcccttgcttggaacttcagagttcactggaagtttttgttttcttctgcagattattgctccccctgagcgtaaatactctgtctggattgggggctccatcttggcctctctgtccaccttccagcaaatgtggattagcaagcaagagtacgatgaggcaggcccatccattgtccaccgcaaatgcttctaagatgccttctctctccatctaccttccagtcaggatgacggtattatgcttcttggagtctcccaaaccaccttccctcatctttcatcaatcattgtacagtttgtttacacacgtgcaatttgtttgtgcttctaatatttattgctttataaataaaccagactaggacttgcaacctataaaagcctctcgtttgtttttggggtaggcgtggggtggggcaggtgtttgctttgacaccctgagcattgtcaaagttcagtagcacaaygttcatccagatgaattaatatgacagttagcrgggagttataatgctaactttgattcatatttggacagaatcatgaatatattcatatccgaagcg

SEQ ID NO: 616 - DNA, 1056 bp, Homo sapiens
  Genbank Accession No. J00123
ttctttttatcattacatcaaattgttttcccaggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggcccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgtttttcatgctaaaaatagttttttgttatcttgtctcttattttttgacaaacatccaataaatgcttacttgtatatagagataataaacctattaccccaagtgcataatatccttgtaagtctctttttctccaaggctc

SEQ ID NO: 617 - DNA, 1089 bp, Homo sapiens
  Genbank Accession No. J00231
  unsure (1)..(1089): n = a or c or g or t
cctggacctcctgtgcaagaacatgaaacanctgtggttcttccttctcctggtggcagctcccagatgggtcctgtcccaggtgcacctgcaggagtcgggcccaggactggggaagcctccagagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccnnngtgcccagcacctgaactcttgggaggaccgtcagtcttcctcttccccccaaaacccaaggatacccttatgatttcccggacccctgaggtcacgtgcgtggtggtggacgtgagccacgaagacccnnnngtccagttcaagtggtacgtggacggcgtggaggtgcataatgccaagacaaagctgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaagccaaaggacagcccnnnnnnnnnnnnnnnnnnnnnnnnnnnnnnnnnnnngaggagatgaccaagaaccaagtcagcctgacctgcctggtcaaaggcttctaccccagcgacatcgccgtggagtgggagagcaatgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgctacacgcagaagagcctctccctgtctccgggtaaatgagtgccatggccggcaagcccccgctccccgggctctcggggtcgcgcgaggatgcttggcacgtaccccgtgtacatacttcccaggcacccagcatggaaataaagcacccagcgctgccctgg

SEQ ID NO: 618 - DNA, 6453 bp, Homo sapiens
  Genbank Accession No. J00277
ggatcccagcctttccccagcccgtagccccgggacctccgcggtgggcggcgccgcgctgccggcgcagggagggcctctggtgcaccggcaccgctgagtcgggttctctcgccggcctgttcccgggagagcccggggccctgctcggagatgccgccccgggcccccagacaccggctccctggccttcctcgagcaaccccgagctcggctccggtctccagccaagcccaaccccgagaggccgcggccctactggctccgcctcccgcgttgctcccggaagccccgcccgaccgcggctcctgacagacgggccgctcagccaaccggggtggggcggggcccgatggcgcgcagccaatggtaggccgcgcctggcagacggacgggcgcggggcggggcgtgcgcaggcccgcccgagtctccgccgcccgtgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtgagtgcgggcagggatcggccgggccgcgcgccctcctcgcccccaggcggcagcaatacgcgcggcgcgggccgggggcgcggggccggcgggcgtaagcggcggcggcggcggcgggtgggtggggccgggcggggcccgcgggcacaggtgagcgggcgtcgggggctgcggcgggcgggggccccttcctccctggggcctgcgggaatccgggccccacccgtggcctcgcgctgggcacggtccccacgccggcgtacccgggagcctcgggcccggcgccctcacacccgggggcgtctgggaggaggcggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgagcagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggtgagcctagcgccgccgtccaggtgccagcagctgctgcgggcgagcccaggacacagccaggatagggctggctgcagcccctggtcccctgcatggtgctgtggccctgtctcctgcttcctctagaggaggggagtccctcgtctcagcaccccaggagaggagggggcatgaggggcatgagaggtaccagggagaggctggctgtgtgaactccccccacggaaggtcctgagggggtccctgagccctgtcctcctgcaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacaggtgaaccccgtgaggctggcccgggagcccacgccgcacaggtggggccaggccggctgcgtccaggcaggggcctcctgtcctctctgcgcatgtcctggatgccgctgcgcctgcagcccccgtagccagctctcgctttccacctctcagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcaggtgaggcagctctccaccccacagctagccagggacccgccccgccccgccccagccagggagcagcactcactgaccctctcccttgacacagggcagccgctctggctctagctccagctccgggaccctctgggaccccccgggacccatgtgacccagcggcccctcgcactgtaggtctcccgggacggcagggcagtgagggaggcgagggccggggtctgggctcacgccctgcagtcctgggccgacacagctccggggaaggcggaggtccttggggagagctgccctgagccaggccggagcggtgaccctggggcccggcccctcttgtccccagagtgtcccacgggcacctgttggttctgagtcttagtggggctactggggacacgggccgtagctgagtcgagagctgggtgcagggtggtcaaaccctggccagacctggagttcaggagggccccgggccaccctgacctttgaggggctgctgtagcatgatgcgggtggccctgggcacttcgagatggccagagtccagcttcccgtgtgtgtggtgggcctggggaagtggctggtggagtcgggagcttcgggccaggcaaggcttgatcccacagcagggagcccctcacccaggcaggcggccacaggccggtccctcctgatcccatccctcctttcccagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgatcttggttttcggctgagggtgggacacggtgcgcgtgtggcctggcatgaggtatgtcggaacctcaggcctgtccagccctgggctctccatagcctttgggagggggaggttgggagaggccggtcaggggtctgggctgtggtgctctctcctcccgcctgccccagtgtccacggcttctggcagagagctctggacaagcaggcagatcataaggacagagagcttactgtgcttctaccaactaggagggcgtcctggtcctccagagggaggtggtttcaggggttggggatctgtgccggtggctctggtctctgctgggagccttcttggcggtgagaggcatcacctttcctgacttgctcccagcgtgaaatgcacctgccaagaatggcagacatagggaccccgcctcctgggccttcacatgcccagttttcttcggctctgtggcctgaagcggtctgtggaccttggaagtagggctccagcaccgactggcctcaggcctctgcctcattggtggtcgggtagcggccagtagggcgtgggagcctggccatccctgcctcctggagtggacgaggttggcagctggtccgtctgctcctgccccactctcccccgcccctgccctcaccctacccttgccccacgcctgcctcatggctggttgctcttggagcctggtagtgtcactggctcagccttgctgggtatacacaggctctgccacccactctgctccaaggggcttgccctgccttgggccaagttctaggtctggccacagccacagacagctcagtcccctgtgtggtcatcctggcttctgctgggggcccacagcgcccctggtgcccctcccctcccagggcccgggttgaggctgggccaggccctctgggacggggacttgtgccctgtcagggttccctatccctgaggttgggggagagctagcagggcatgccgctggctggccagggctgcagggacactcccccttttgtccagggaataccacactcgcccttctctccagcgaacaccacactcgcccttctctccaggggacgccacactcccccttctgtccaggggacgccacactcccccttctctccaggggacgccacactcgcccttctctccaggggacgccacactcgcccttctctccaggggacgccacactcgcccttctgtccaggggacgccacactcgcccttctctccaggggacgccacactcgcccttctctccaggggacgccacactcccccttctgtccaggggacgccacactcccccttctctccaggggacgccacactcccccttctctccaggggacgccacactcgcccttctctccaggggacgccacactcccccttctgtccaggggacgccacactcgcccttctctccaggggacgccacactcgcccttctctccaggggacgccacactcccccttctctccaggggacgccacactcccccttctctccaggggacgccacactcccccttctgtccaggggacgccacactcgcccttctctccaggggacgccacactcccccttctctccaggggacgccacactcccccttctctccaggggacgccacactcccccttctgtccaggggacgccacactcgcccttctctccaggggacgccacactcgcccttctctccaggggacgccacactcgcccttctctccaggggacgccacacttgcccttctgtccagggaatgccacactcccccttctccccagcagcctccgagtgaccagcttccccatcgatagacttcccgaggccaggagccctctagggctgccgggtgccaccctggctccttccacaccgtgctggtcactgcctgctgggggcgtcagatgcaggtgaccctgtgcaggaggtatctctggacctgcctcttggtcattacggggctgggcagggcctggtatcagggccccgctggggttgcagggctgggcctgtgctgtggtcctggggtgtccaggacagacgtggaggggtcagggcccagcacccctgctccatgctgaactgtgggaagcatccaggtccctgggtggcttcaacaggagttccagcacgggaaccactggacaacctggggtgtgtcctgatctggggacaggccagccacaccccgagtcctagggactccagagagcagcccactgccctgggctccacggaagccccctcatgccgctaggccttggcctcggggacagcccagctaggccagtgtgtggcaggaccaggcccccatgtgggagctgaccccttgggattctggagctgtgctgatgggcaggggagagccagctcctccccttgagggagggtcttgatgcctggggttacccgcagaggcctgggtgccgggacgctccccggtttggctgaaaggaaagcagatgtggtcagcttctccactgagcccatctggtcttcccggggctgggccccatagatctgggtccctgtgtggcccccctggtctgatgccgaggatacccctgcaaactgccaatcccagaggacaagactgggaagtccctgcagggagagcccatccccgcaccctgacccacaagagggactcctgctgcccaccaggcatccctccagggatcc

SEQ ID NO: 619 - DNA, 2133 bp, Homo sapiens
  Genbank Accession No. J03040
cgggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaatccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgaaaaaaaaaaaaaaaaaaaaaaaaaaaaaa

SEQ ID NO: 620 - DNA, 5416 bp, Homo sapiens
  Genbank Accession No. J03464
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgggccctcctctgcgcccccgcaggctcctcccagctgtggctgcccgggcccccagccccagccctcccattggtggaggcccttttggaggcaccctagggccagggaaacttttgccgtataaatagggcagatccgggatttgttattttagcaccacggcagcaggaggtttcggctaagttggaggtactggccacgactgcatgcccgcgcccgccatgtgatacctccgccggtgacccagggctctgcgacacaaggagtcgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtggtcttcctggtgagagaggacgtgttggtgcccctggtccagctggtgcccgtggaagtgatggaagtgtgggtcccgtaggtcctgctggtcctaatgggtctgctggccctccaggtttcccaggtgcccctggtcccaagggtgaaattggagctgttggtaacgctggtcctactggacccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctcctggtgctgccggtactactggtgccagaggacttgttggtgagcctggtccagctggctccaaaggagagagcggtaacaagggtgagcccggctccgctggtccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggccccgttggagcaagaggagagcctggcaacattggattccctggacccaaaggccccactggtgaccctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggaggcaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttcaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagcggttactactggattgaccccaaccaaggatgcactatggaagccatcaaagtatactgtgatttccctaccggcgaaacctgtatccgggcccaacctgaaaacatcccagccaagaactggtataggagctccaaggacaagaaacacgtctggctaggagaaactatcaatgctggcagccagtttgaatataatgttgaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 621 - DNA, 3890 bp, Homo sapiens
  Genbank Accession No. J03507
atgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccatggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttgaagcgattcttgtgcctcagcttcccaagcagctgggattacaggtgcccgccaccacgcccagctaatttttgcatttttagtagagatgggtttcaccatgttggccatgctcgtctccaactcctgacctcaggtaatccgtctgccttggcctcccaaatgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaagatgctattcttc

SEQ ID NO: 622 - DNA, 1922 bp, Homo sapiens
  Genbank Accession No. J03910
gagacctgggcgttggtgaaggcgaggggaaagccagaatactggggtggcggacgccaaggggcgggtgtagcaggcaacctcagggaagctgggaaggcctagcagggtgagagaacccgcacacggggggcacagcgcctccctcgcgagccggtgcgaaaggggccgcctgcggtgtgcgcccagctgcgctcaagggaccttgcacttggcccatctcctgcgcacagcccaggccgggaccgcgggcggtgcggactcagcgggctgggtgcaagggcggggcggggcgtctgcgcccggccccgtctcctgactataaaagcagccgctggctgttgggctccactccgccttccacgtgcacccactgcctcttcccttctcgcttgggaactctagtctcgcctcgggttgcaatggaccccaactgctcctgtgccgctggtaagggacgcccgggttctgtgccttggaatgccaaattcccagacaccatagagagtgtccctgggtttgaggaggtcgtattttgctatcagaggtaaggggactcctttattggtccagtgctttcctgttggccaagctcctgagggcattttcctcctccctgttcctctatgtcagagttgagggtcctgaggctcaaggctgtcctgctcatgtcagagttgagggtcctgaggctcaaggctgtcctgcctcacgtcacctagttggtcacagggctgctggctgagccccaattctctaacctgactctgagctaccggattggataggagacattggataggagggacattgcctcttccaagttcaggacagaaagtcgaagtcttcctaggccgtgatctgcagggactttcctttggagtagaaataggagggtgcttggttttcccagcatgaatggagaggacatggggcttctcttcctcgtctctgagtgggaaaggagctctgacggctggctctggcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcctgcttctggggaaccggccttcctttgtccctgtaggttgtcacgcctgtctagtcttctgcactttccaaggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctatgatcgagtctgctctgacctctcaatctcctttcctccccaaggctgctgctcctgctgccctgtgggctgtgccaagtgtgcccaaggctgcatctgcaaaggggcatcggagaagtgcagctgctgcgcctgatgtcgggacagccctgctcccaagtacaaatagagtgacccgtaaaatctaggattttttgttttttgctacaatcttgacccctttgctacattcccttttttctgtgaaatatgtgaataataattaaacacttagacttgattcccgttctggttcctgttgtgtttttggaatgagggactggggtgggagattgaactgggagttcacactgggctctggacggaaatgtgagtgctaaacaagctgagcgccttcaggcagccccgttacttctctgacctccttcctctgtaaaaggcacctgcaccgtgccggatgatatggggatggggacatacgcg

SEQ ID NO: 623 - DNA, 2700 bp, Homo sapiens
  Genbank Accession No. J04076
tctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgacccacagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctgggatgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcaggcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 624 - DNA, 3622 bp, Homo sapiens
  Genbank Accession No. J04111
cccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtggttcgggagtgtccagagagccttgtctccagccggccccgggaggagagccctgctgcccaggcgctgttgacagcggcggaaagcagcggtaccccacgcgcccgccgggggacgtcggcgagcggctgcagcagcaaagaactttcccggcggggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcacgccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggaggggttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttcggtctgacggcgcccccagtgtgcacgagtgggaaggacttggtcgcgccctcccttggcgtggagccagggagcggccgcctgcgggctgccccgctttgcggacgggctgtccccgcgcgaacggaacgttggactttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgctttcgttaactgtgtatgtacatatatatattttttaatttgattaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatcctagtctatctaggtggagttgaaagagttaagaatgctcgataaaatcactctcagtgcttcttactattaagcagtaaaaactgttctctattagacttagaaataaatgtacctgatgtacctgatgctatgtcaggcttcatactccacgctcccccagcgtatctatatggaattgcttaccaaaggctagtgcgatgtttcaggaggctggaggaaggggggttgcagtggagagggacagcccactgagaagtcaaacatttcaaagtttggattgcatcaagtggcatgtgctgtgaccatttataatgttagaaattttacaataggtgcttattctcaaagcaggaattggtggcagattttacaaaagatgtatccttccaatttggaatcttctctttgacaattcctagataaaaagatggcctttgtcttatgaatatttataacagcattctgtcacaataaatgtattcaaataccaataacagatcttgaattgcttccctttactacttttttgttcccaagttatatactgaagtttttatttttagttgctgaggtt

SEQ ID NO: 625 - DNA, 696 bp, Homo sapiens
  Genbank Accession No. J04130
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcctatggggatggtccactgtcactgtttctctgctgttgcaaatacatggataacacatttgattctgtgtgttttccataataaaactttaaaataaaatgcagacagtta

SEQ ID NO: 626 - DNA, 853 bp, Homo sapiens
  Genbank Accession No. J04164
ctagtcctgacttcacttctgatgaggaagcctctctccttagccttcagcctttcctcccaccctgccataagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgtcactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 627 - DNA, 1888 bp, Homo sapiens
  Genbank Accession No. J04605
ccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttcctccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagagccgagtgtttaagacggatatggagctggaggttctgcgctataccaataaaatctccagcgaggcccaccgtgaggtaatgaaggctgtaaaagtgggaatgaaagaatatgggttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactctgtcgcttccgacatcacctgctcctttccccgcaacggcaagttcactgcagaccagaaggccgtctatgaggcagtgctgctgagctcccgtgccgtcatgggtgccatgaagccaggtgactggtggcctgacatcgaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgatcgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggcaccacctttaatctgttttataccttgcttattaaatgagcgacttaaaatgattgaaaataatgctgtcctttagtagcaagtaaaatgtgtcttgctgtcatttatattccttttcccaggaaagaagcatttctgatactttctgtcaaaaatcaatatgcagaatggcatttgcaataaaaggtttcctaaaatg

SEQ ID NO: 628 - DNA, 2099 bp, Homo sapiens
  Genbank Accession No. K02215
aagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccac

SEQ ID NO: 629 - DNA, 8090 bp, Homo sapiens
  Genbank Accession No. K02405
ggatccttttgtaacattaaacaagtcatattaatcttaaatttgtatatgtgaagatctagatgtaaaatgcatgaaacatgatccacattttacaaagagaagcctggggcaaaataaattcagtaatttgttgactctcataaagcacattagtggtggaactgcaactcaccattatttccttctaagaactttgctctttcaccaaaacttaaggctcctcagggtgtgtctaagacaacagcagtaaaaatgtctatgacagcaattttctctcccctgaaatatgatccccacttaatttgccctattgaaagatcccaagtataagaacaactggtttttaatcaatattacaaagatgtttactgttgaatgcatttttctttggcttcttaaaatcccttaggcattcaatcttcagctcttccataattgagaggaattttcacctcaaatgttcatccagtgcaattgaaagacgtccagtgcaggcactggattcagaaccttcacaaaaaaaaaatctgcccagagacagatgaggtccttcagctccagtgctgattggttcctttccaagggaccatccaatcctaccacgcatggaaacatccacagatttttattctttctgccaggtacatcagatccatcaggtccgagctgtgttgactaccacttttcccttcgtctcaattatgtcttggaaaaaggctttgcggatccccggaggccttcgggcagcaactgtgaccttgatgctgtcgatgctgagcaccccagtggctgagggcagagactctcccggtaagtgcagggcagctgctctccagagccgctactctgggaacaggctctccttgggctggggtacggggatggtgatctccataatctcggacacaatcttttatcaacatttcctctgttttgggaaagagagctatgttgcatttccatttatcttttaatgatgaagtgaggacaatccaatcccatcctacggacttaagccgaagaggaggagagaggagagaaaagaggagacaaagtgttcatttactaccagtgataggacaaagtgagcatggggttatttttgaaagatatgaatttctccaaagacacagcaggatttgccatttaggcgtgtcccaagacttgcctgactaaatattatgatttcctgcattgggaaatgcaaggcagcaatggtgtctgtagtctccgtatttggggaaaagttgtctgcattcctgacccagtggagcgtttgtggaggcaaaatcttggtactgagggaagctgactggcactccacagaaagagagccttcaggtttcggcaaatggtgacctgagtgggattccagatacccgagttgatgatggactaaatttagtagaaaggaggatgtaaagaagggaaataacacatactgtgaaaccaactcatttcagacacggaacaatactttacataaattctctctcactccttctaacatcctgtgtgtagatatcatgattttcttttacacaattatacttgtagtatggatattctgttacataaactgcccgggctggtgactgccacagttcaatgggaatctagtttatcaaattcaaaagcttgtgctctttcggtgaataaatgtttctttctaggactcagagatctaggactcccttctttctaacacagcgtgagtgaacctcacagggcacttgggagggtaaatccaggcatgggaaggaaggtattttacccagggaccaagagaataggcgtatcggaagaggacaggtttaattctgaacctgtctcgtcattcccttgaactgtcaggtttatgtggataactttatctctgaggtacccaggagctccatggaaaatgagatttcatgcgagaacgccctgatccctctaagtgcagaggtccatgtaaaatcagcccgactgcctcttcacttggttcacaggccgagacagggacagggctttcctccctttcctgcctgtaggaaggcggattcccgaagaccccgagaggggcgggcagggctggcagagttcgggaggatcccaggtctgcagcgcgaggcacgggccggcgggaacttgtggtcgcgcgggctgttccacacgtccgggccgggtcagggtggcggctgcgggggcggacgggctgggcgcactgactggccggtgattcctcgcagaggatttcgtgtaccagtttaagggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgaggtgagcggcgtcgcccctctgcgaggcccacccttggccccaagtctctgcgccaggaggggcgaagggtcgtggcctctggaacctgagccccgtttgttccaccccagaggacaggaggcagcggcgagagtggtgggggcagggtcatcggaggtgcggggacctaggcagagcagggggacaggcagagttggccaggctgcctagtgtcgccccagcctacccgttcgtcggccttgtcctctgctctgcatgttcttgcctcgtgccttatgcatttgcctccttttgccttacctttgctaagcagctctctctgctcagaatgcccgccctcttcccctgcccgcccgcccgccccactagcactgccccacccagcaaggcccatcgtgcacagctcttgcagcaggaagcttcaggcttagcctggtggagttagggctgttccacaactgcgcgcaggacattcagcaattacagttgtgaaataagatattttaacttttggcttcaaatcattattcatcgtaattctgttttcttaaatggctctcattcatggcagagatctttgaggtgagggtgttttaatcattgcatgcctagtacctgacacattgactggtatgtggtgtgagctcaatgatcttctgttaaattaatgaataaatgtactcagctgcccatccacttaggctcaagaaaaaaaaagaggtaaacagagccttaaaaatggactttattaattattttctataattttgcttaatgctttaaagtaaactcttattgacttggatcttaatagagtttgtgaatacaaaatctgaggaaaaaagtttttgctaaaaataaaaacaacgcttgaaagatattgtaaggcagttcaaatttcttttcttttcttttttttttttttttgagacggattctcactctgtcgcccaggccggagtgcagtggcgcatctcggctcactgcaagctccgcctcccgggttcacgccattctcctgcctcagcctcctgagtaggtgggattacaggcgcgtgccaccacgcccggctaatttttttgtatttttagtagaggcggggtttcaccgtgttagccaggatggtctggatctcctgacctcatgatccgcccgcctcggcctcccaaagtgctgggattacaggtgtgagccacagtgcccggccggcactttaatttcttagaaaaagctgaacaaatggcacaatgcaaagagcaaaagttttggaataaatagattgaagccattaaattattggataaaaatagtttcgggttgcttttggcctaggttctcccctccccccatgactatccacttcaggaataaacattctgaaagtcaattttacccatttgatgagacatttatttctagacagttgccttatcaaataccatctatgttacgtcatttaatctcacagttacttgtgcatcagagattagcatcaccactttatatattggtacatgataaacactttattggtcatggatggggagatggtcactgtaggctaatattggtacatgataaacactttaagtaatcagcccataattgctcaccaagaccttaagcctcccaaagtacacaacattctttgtgttcttcactacacatccatagagtctaagggacgtaagcctcgttaaagccagttttagaccgagaagcagcaatgagtctatcctgtgtgatttccatgttaatgggacaaaatgatactttcaaggcattgaaaattcatgattaatcaatccctagtctgaccccagtgttatctatgcaggtttgcaaaacctttagttcactaatactccccttgccttcttttgattcacatcctaatgccagcaaatacttattttttgctatttcagttccatttccataaaatttattttatcatcttttctcataaatttatgccctctatttttactcccaatctgttcaagatgaacaaatcttataaggccacatagctgactgttatttctgttggatctcaggaaggagaacctaaagaaaagttcaagtccaagcagaaaccgtgatttcttccagatgatggctcatgagtgccatttaattggggtgccacctggtgacctcagcaaatcccagctatatttatgtgttcacattacaggatcattaacccagaccgaccactgcacaagatctcagaatattttctatgggagaacatacataataatgcctgatttcagaagaagaaagtaattctcaatagcaaggggatggagtagggtagacagctgtaattaaactcacttgtgtgataaaaagaaattaagggaaaaagaaaatgaggagaacatattactaaataaagaaagcatacattaaatatttactatagtttcacactaagagaataaaggaaatgcaataaagtggcctgaaaggtaaaggatgagatgtgtaaaggggtgtagtatttttcatatgacgacgaactgagaagataaaggaatcgagttacgggcaaacatgatgtttgatcagtgttatttgttttcaaggcctgcctaaatttttttcaaatattacaaacttttgaaataacatttctttttgttttttgctgtctgttactaggttgcacatttcataaaggcagggaccatggtatgttgtttgtctttggattctcagtgattgttatatttatatttgttgaaggaaccttaatccaagacttggactccaagtatctttccactctggttccaaggagggacctccctccagcaggcatgctgtgtggtctcacatctcactcctatatctttccctgtctgttactgccctcagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtggcgtaaggggatattgagtttctgttactgtgggccccacaagacaaaggacagagctccttctgacccatcccttcccatctcttatccctgatgtcactgctgagctgggaatcacaggagactagagcacctctagttccatggcgagtgcatcagaagaatcctgatctcatcacctttccagatgctagggaaattactctacatactgttgctctggatccagtcctgattgctctgaggaactgattattagggctggtgactgggatcttagggtctaagtttatggatgagttcctgaggagtggagatctgcttccccactctgtcacctactcactgtatccaaggacctattggctggcctttccctcccttaggggtggtctgaatggagaactaggttcctttgatgccttcacctcctgcatctcagactggacttcaagctcctcatcagggaaactatggggtatggggacaaacactgacactcaggctctgcttctcaggggctcaatctgaatctgcccagagcaagatgctgagtggcattggaggcttcgtgctggggctgatcttcctcgggctgggccttatcatccatcacaggagtcagaaaggtgaggaaccccaggggaaaaggggaagatggcctgtgacccagaccctctgttcagagaggtcctgtctctagatgtagctctttcctcctgaccctgagaggaagaaagctgagctggaagtggaaggagacaggacaaggttggaggaggcattggaatctgattttactagctgaagggtagccctgtcacagagctgactgatagagcttattccagggcatccttaccattcatcattgtctcactggctcctttccaaaaacttcctccattaagagggtcagagcctcggcctccttaccttctagtgacaatttccttcattttaggggatttcaaattagggtgctcaaggactcgaagaacatgaatgggaagagaatataactctaattaagtcacatgtgtcattttcctttggggtgagagagtgactgttcatgtaatgagacctttctctgcataacttccttttgtaagacctcaagggccaccagcaggtaatatttcgagccggcatccagtgtggggagggcacaggtgtaagagggaagagcatgagctgagtgtacctgacagtagtggtctctgttcatggtatatttgctgctataggatcaagacttaggggtgaagtttgccagtttctaggaatctccagaggttgttccccagaaccaagccttaactttggtggtatcttcctgttaaatgtggagccagaaccacggcttaaatgttagacactaggatgatgcccactttgtgccacatgatggtggctactgcctgtaggcattttccagtgactgaaagaggctgctagtggtagggatgaggtatcatccaatttcctaaaaagattgaacccttcatattcaccagaagagtaacagctgttcccccacctcccacacatctgcatcaagctgaagttctgtgtcttcatgagctgatttctcctttgcacagatcttgggggaggtgatgacaatacactctggacctcagctttgtctgtctgaagctgcaggaggcccctgaggggtggggaagatggcaggcccaccagcgtaccctgtgctgatcatccctcttctctcttcttcagggctcctgcactgactcctgagactattttaactgggattggttatcacttttctgtaacgcctgcttgtccctgcccagaattcccagctgtctgtgtcagcctgtccccctgagatcagagtcctacagtggctgtcacgcagccaccaggtcatctcctttcatccccaccttgaggcggatggctgtgaccctacttcctgcactgacccacagcctctgcctgtgcacggccagctgcatctactcaggccccaaggggtttctgtttcctattctctcctcagactgctcaagagaagcacatgaaaaccattacctgactttagagcttttttacataattaaacatgatcctgagttatctgtattctgaacttccttaattgagcagaggcaggaaatcactgcagaatgaaggaacataccttgaggtgacccagccaacctgtgcccagaaggagggttgtaccttgaaagacactgaaagaatttggggtgcaaagtcatggtgggcagaggaggtagaaaatcaactcagttgttgcatcattcatggttctttcatattgatgttcagtgcagtggcctgagaatatcccagcctctcttctggtttggtgagtgctatataagtaaacatggtggaattgtttgggggcagatag

SEQ ID NO: 630 - DNA, 1173 bp, Homo sapiens
  Genbank Accession No. K03204
gcacagagttgggagtgactccagagcctcctgcaagatgctgttgattctgctgtcagtggccttgctggccctgagctcagctcagaacttaaatgaagatgtcagccaggaagaatctccctccctaatagcaggaaatccacaaggaccatccccacaaggaggcaacaagccccaaggccccccacctcctccaggaaagccacaaggaccacccccacaaggaggcaacaaacctcaaggtcccccacctccaggaaagccacaaggaccacccccacaaggggacaagtcccgaagtccccgatctcctccaggaaaaccacaaggaccacccccacaaggaggtaaccagccccaaggtcccccacctcctccaggaaagccacaaggaccacccccacaaggaggcaacaaacctcagggtcccccacctccaggaaagccacaaggaccacccccacaaggagacaagtcccaaagtccccgatctcctccaggaaagccacaaggaccacccccacaaggaggtaaccagccccaaggtcccccacctcctccaggaaagccacaaggaccaccccaacaaggaggcaacagacctcaaggtcccccacctccaggaaagccacaaggaccacccccacaaggagacaagtcccgaagtccccaatctcctccaggaaagccacaaggaccacccccacaaggaggcaaccagcctcaaggtcccccacctcctccaggaaagccacaaggaccacccccacaaggaggcaacaaacctcaaggtcccccacctccaggaaagccacaaggaccacccgcacaaggaggcagcaagtcccaaagtgcccgagctcctccaggaaagccacaaggaccaccccaacaagaaggcaacaatcctcaaggtcccccacctccagcaggaggcaatccccagcagcctcaggcacctcctgctggacagccccagggaccaccacgccctcctcaagggggcagaccttccagacctccccagtgacagcctccccagtcatctaggattcaatgacaggaagtgaataagaagatgagagtgattcaaatgattcaaattccatgacattggaaaaaggtcatcatagctctaacttcaatataccaataaaataatcagcttgc

SEQ ID NO: 631 - DNA, 1552 bp, Homo sapiens
  Genbank Accession No. L02321
caaagtctgagccccgctccgctgatgcctgtctgcagaatccgcaccaccagcaccatgcccatgactctggggtactgggacatccgtgggctggcccacgccatccgcttgctcctggaatacacagactcaagctatgtggaaaagaagtacacgatgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgaactcaggactgtcctcgaattgtgggtggttttttgtcttctgttgtccacagccagagcttagtggatgggtgtgtgtgtgtgtgtgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 632 - DNA, 382 bp, Homo sapiens
  Genbank Accession No. L02326
ggtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccaccacaggggcctggagctgcaggatcccaggggaggggtctctc

SEQ ID NO: 633 - DNA, 9287 bp, Homo sapiens
  Genbank Accession No. L02870
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggtggagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccttccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgagtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggcaaaaaa

SEQ ID NO: 634 - DNA, 2136 bp, Homo sapiens
  Genbank Accession No. L04270
gccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcactttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 635 - DNA, 2731 bp, Homo sapiens
  Genbank Accession No. L05500
aagaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggtcacagcacagcagtgactcggtgaggggag

SEQ ID NO: 636 - DNA, 1670 bp, Homo sapiens
  Genbank Accession No. L06797
cggcacgaggcaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaagagacttttttttatacgataaataacttttttttaagttacacatttttcagatataaaagactgaccaatattgtacagtttttattgcttgttggatttttgctcttgtgtttctttagtttttcgtgaaggtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaa

SEQ ID NO: 637 - DNA, 3934 bp, Homo sapiens
  Genbank Accession No. L08246
tccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggtcttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttccttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaagcctgtctgccaaatccagtggaaacaagtgcatagatgtgaattggtttttaggggccccacttcccaattcattaggtatgactgtggaaatacagacaaggacttagttgatattttgggcttggggcagtgagggcttaggacaccccaagtggtttgggaaaggaggagggagtggtgggtttataggggaggaggaggcaggtggtctaagtgctgactggctacgtagttcgggcaaatcctccaaaagggaaagggaggatttgcttagaaggatggggctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaataaa

SEQ ID NO: 638 - DNA, 2828 bp, Homo sapiens
  Genbank Accession No. L13698
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggtggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgtttttttaaaaatcctaagtttttaaataactatggatttgtgtattttttttggttatttgttttattaaaacatgtacatcagtaaagagttttaaacaatga

SEQ ID NO: 639 - DNA, 2464 bp, Homo sapiens
  Genbank Accession No. L13740
cggaaacttgggggagtgcacagaagaacttcgggagcgcacgcgggaccagggaccaggctgagactcggggcgccagtccgggcaggggcagcgggacgcggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcacgttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccactggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtccaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccttgcacacctggattcagggcccagcactgccaaactggactactccaagttccaggagctggtgctgccccactttgggaaggaagatgctggggatgtacagcagttctacgacctgctctccggttctctggaggtcatccgaaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgcctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttg

SEQ ID NO: 640 - DNA, 3301 bp, Homo sapiens
  Genbank Accession No. L13852
aggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaaggtgtcttgagcctatggtggcatgctgggtcagtagctgcccaggaagtgctgaaggcaatctccagaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacctccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataattgcttgttaaaggaagg

SEQ ID NO: 641 - DNA, 1319 bp, Homo sapiens
  Genbank Accession No. L19437
cgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcaaaaaaaaaaaaaaaaaaaaaaaaaaaaaaaaaaaaaaaaaaaaaaaaaaaaaaaaaaaaaaaaaaaaaaaaaaaaa

SEQ ID NO: 642 - DNA, 1914 bp, Homo sapiens
  Genbank Accession No. L19871
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 643 - DNA, 309 bp, Homo sapiens
  Genbank Accession No. L22524
ctctcaataggaaagagaagtaattcaagaaagaaatagaaacttcaggcagaacatccattcattcattcattggattgtatatcattgttgcacaatcagaattgataagcactgttcttccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttatt

SEQ ID NO: 644 - DNA, 5911 bp, Homo sapiens
  Genbank Accession No. L25270
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgcccgcttaggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggacgtctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtagggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttca

SEQ ID NO: 645 - DNA, 1480 bp, Homo sapiens
  Genbank Accession No. L33799
ctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttacgtggcaagtgaggggttccccaactcctacccccctaataaggagtgcatctggaccataacggtccccgagggccagactgtgtccctctcattccgagtcttcgacctggagctgcaccccgcctgccgctacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggctctgagcaccaattttgcggggggcggctggagaaggcccagggaaccctgaccacgcccaactggcccgagtccgattaccccccgggcatcagctgttcctggcacatcatcgcgcccccggaccaggtcatcgcgctgaccttcgagaagtttgacctggagccggacacctactgccgctatgactcggtcagcgtcttcaacggagccgtgagcgacgactcccggaggctggggaagttctgcggcgacgcagtcccgggctccatctcctccgaagggaatgaactcctcgtccagttcgtctcagatctcagtgtcaccgctgatggcttctcagcctcctacaagaccctgccgcggggcactgccaaagaagggcaagggcccggccccaaacggggaactgagcctaaagtcaagctgccccccaagtcccaacctccggagaaaacagaggaatctccttcagcccctgatgcacccacctgcccaaagcagtgccgccggacaggcaccttgcagagcaacttctgtgccagcagccttgtggtgactgcgacagtgaagtccatggttcgggagccaggggagggccttgccgtgactgtcagtcttattggtgcttataaaactggaggactggacctgccaactccacccactggtgcctccctgaagttttacgtgccttgcaagcagtgcccccccatgaagaaaggagtcagttatctgctgatgggccaggtagaagagaacagaggccccgtccttcctccagagagctttgtggttctccaccggcccaaccaggaccagatcctcaccaacctaagcaagaggaagtgcccctctcaacctgtgcgggctgctgcgtcccaggactgagacgcaggccagccccggcccctagccctcaggcctctcttcttatccaaataaatgtttcttaatgaaa

SEQ ID NO: 646 - DNA, 444 bp, Homo sapiens
  Genbank Accession No. L34587
agatttggcacgagtcggcacgaggcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataata

SEQ ID NO: 647 - DNA, 370 bp, Homo sapiens
  Genbank Accession No. L44416
tattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattccttagggagagagggatggtttctggggggttctgaaagtatgattcaatgtgcaacatacaggtaggtcttcagcataagctgaaatatatgcatgtaaaaactttgacatctttttttttaattttccactttcttcttaactttacttctctttt

SEQ ID NO: 648 - DNA, 334 bp, Homo sapiens
  Genbank Accession No. L44497
  unsure (1)..(334): n = a or c or g or t
ggcatttactcttggccctttcagtacaggcgaagtgttctattgcatcacaagtgctagtgntgcagtaacagatccaagggcataatattaaatatgtttttttccaactgcggtttagttgaagaataacanaatacaaacatatnttnatggntatcangaccagcagtgatctgcagaatatnnngaggcctacctaattagaaggttgaaacttagtaaaaccgtgttaaagtcagtgtttttattcttagattaacaatggcagagtgagataactttgattacaattttataaggtgtggtggggncttgagcggagccagctatt

SEQ ID NO: 649 - DNA, 3775 bp, Homo sapiens
  Genbank Accession No. L49169
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 650 - DNA, 839 bp, Homo sapiens
  Genbank Accession No. L76200
atgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctgggtgacccccgacccagcctcgctgggctgtcccctgtccctatctctcactctggacccagggctgacatcctaataaaataactgttggattag

SEQ ID NO: 651 - DNA, 423 bp, Homo sapiens
  Genbank Accession No. L77701
ccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaagatcttc

SEQ ID NO: 652 - DNA, 1763 bp, Homo sapiens
  Genbank Accession No. M10942
cccgggacggcagcaggtgggctgcacacggactctgggacaagtcgagctgaaaaccgcggagcaggggtggggtggagacgcccgcgacgccaaggctggggtcccggaacacgctgggaggagggtggaaggcaacctcggggaaactgggaaaggcggcctggacttcgggaacaccgcgtacctgcgggggcacagcccacccgagcgaacgggctccaaagggaaggtcccgcggtgcccaccggcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatccccatttcccagccctattacagagggtctctgggtttcaggaagtcgcattttaagttctgagcgacggggactccagtacttcgttagatgctttcttcctgatcacgcccctgagagcattgccctcatccctgggcctctacgtcagagttaagaatactgaggctcaaggctgaactgctccacatcacccagttggtcatgggcctgctggctgggccccagtgctctgtccaggctctgagcaatcagtgtggttgggggtgctggaaacattgactcttcagagttcaggacagaaggttctggctcgcagtctcaatattcctgggttgtatgtgcacgtgggaccttcctggtgcggtaaaacaggagggtccttgccccttccccagcgttagtgagaggacatggggcttctgttcctctgtcctgagtgggaaaggagctctgagggctggccctgcacagaggagggggcactggagactcactgacccactgctgtaccttctgcatctcactcactgcccactgcgttttcctcttccttgtaggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaatcttactccctgttcttct

SEQ ID NO: 653 - DNA, 1144 bp, Homo sapiens
  Genbank Accession No. M11119
ggaaatgactgacctgatgtgtgttataacccatctgagccccctacaaccaccagttttgaaataagattaagaactggccttttcctaggtgatacaagtgaaataataactagaacagaagaaaaaggaatccccaaacaagtaactttaagatttgacgcttgtgcagccattaatagtaacaagctaggaacaggatgtggttctcttaactgggaaaggagctacagagtagaaaataaatatgtttgtcatgagtcaggggtttgtgaaaattgtgccttttggccatgtgttatttaggctacttggaaaaagaacaaaaaggacttggttcatcttcagaaaggggaagccaacccctcctgtgctgccagtcactgtaacccactagaactaataattaccaatcccctagatccccattggaaaaagggagaatgtgtaaccctggggaccaaagggacagggttaaacccccaagttgccattttagttcaaggggaggtccacaagcactctcccaaaccagtgtttcaaaccttttatgaggagttaaatctgccagcaccagaacttctgaaaaagataaaaaatttgtttctccaattagcagaaaatgtagctcattcccttaatgttacttcttgttatatatgcgggggaaccactatcagagaccgatggccttgggaagcctgagagttggtgcccactgatccagctcctgatataatgggggcttgtccaggatctcatcaggactggatggctctcgctggactatactggatatgtgggcagagagcctacattcagttacctaatgaatgggcagacagttgtgttattggcactattaagccatcctttttcttattaccgataaaaactactggtactatctgtaaattccagacattgtatgagaaagcactgtaaaactttttgttctgttagctgatatatgtagcctccagtcacattcctcatgcttacttgatctatcatgaccctttcacgtggaccccttagagttgtaagcccttaaaagggctaggaatttctttttgggggagcttggctcttaagacatgagtctgccaatgctaccggccaaataaaaacctcttccttcttt

SEQ ID NO: 654 - DNA, 4577 bp, Homo sapiens
  Genbank Accession No. M11313
gctacaatccatctggtctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaacgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttttattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggggtggctgaggtaggagtaacagtccctgacaccatcaccgagtggaaggcaggggccttctgcctgtctgaagatgctggacttggtatctcttccactgcctctctccgagccttccagcccttctttgtggagcttacaatgccttactctgtgattcgtggagaggccttcacactcaaggccacggtcctaaactaccttcccaaatgcatccgggtcagtgtgcagctggaagcctctcccgccttccttgctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagccgccacatttaccaggactgggaaggctgcacaggtgactatccagtcttcagggacattttccagcaaattccaagtggacaacaacaatcgcctgttactgcagcaggtctcattgccagagctgcctggggaatacagcatgaaagtgacaggagaaggatgtgtctacctccagacctccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctcaaaccagccatagtgaaagtctatgattactacgagacggatgagtttgcaatcgctgagtacaatgctccttgcagcaaagatcttggaaatgcttgaagaccacaaggctgaaaagtgctttgctggagtcctgttctctgagctccacagaagacacgtgtttttgtatctttaaagacttgatgaataaacactttttctggtc

SEQ ID NO: 655 - DNA, 1157 bp, Homo sapiens
  Genbank Accession No. M12529
ccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaagtcacccaagaactgagggcgctgatggacgagaccatgaaggagttgaaggcctacaaatcggaactggaggaacaactgaccccggtagcggaggagacgcgggcacggctgtccaaggagctgcagacggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatcccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagtcggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 656 - DNA, 1524 bp, Homo sapiens
  Genbank Accession No. M12959
gaattcccttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggaggaaccagagcccagtcggtgacccagcttggcagccacgtctctgtctctgaacgagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgatctcgaaccgaacagcagtgcttccaagataatctttggatcagggaccagactcagcatccggccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttcattaaaatgatttggaaggggatcc

SEQ ID NO: 657 - DNA, 676 bp, Homo sapiens
  Genbank Accession No. M13560
accccaacctcaacccgccgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacactctggttcctgccctttctgttgagaga

SEQ ID NO: 658 - DNA, 1493 bp, Homo sapiens
  Genbank Accession No. M13955
gaattccggcgagtgcgcgctcctcctcgcccgccgctaggtccatcccggcccagccaccatgtccatccacttcagctccccggtattcacctcgcgctcagccgccttctcgggccgcggcgccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaaagccctcaacaacaagtttgcctccttcatcgacaaggtggggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggagcaggggctgcggacgatgcaggatgtggtggaggacttcaagaataagtacgaagatgaaattaaccgccgcacagctgctgagaatgagtttgtggtcctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagtgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcc

SEQ ID NO: 659 - DNA, 2813 bp, Homo sapiens
  Genbank Accession No. M14660
gccatgctcccatttcttgacatataaatctgtgtctcaaagtccatctttgtgtttttccctacagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgccaatttgaactgtaaccatttgcttagtcacctttagtggagtaatcctactgggcttgtttctatatttatataaagcagccaaatccttcatgtaatattgaagtccatttttgcaatgttgttccatacttggagtcattttgcagcccatagaggttagtcctgcatagccagtaatgtgctaagttcatccaaaagctggcggaccaaagtctaaatagggctcagtatccccctatcgcttatctctgcctccttcctcctccttcccagtctatcatcaaccttgagtattctacacatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcaccctcctcatagtcataatgtagcaagtaaagaatgagaattgggttcttctacaatacaactagaaaccaacaattaatggtatttctttaaaacctgtgtgaaaaaataaatgttgtccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataataaagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagctt

SEQ ID NO: 660 - DNA, 1522 bp, Homo sapiens
  Genbank Accession No. M16336
aaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctataaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctcccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaagtgtagaggaccgagccagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactag

SEQ ID NO: 661 - DNA, 849 bp, Homo sapiens
  Genbank Accession No. M18737
atgaggaactcctatagatttctggcatcctctctctcagttgtcgtttctctcctgctaattcctgaagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgaacaaaaggtcccaggtcattcttggggctcactcaataaccagggaagagccaacaaaacagataatgcttgttaagaaagagtttccctatccatgctatgacccagccacacgcgaaggtgaccttaaacttttacagctgacggaaaaagcaaaaattaacaaatatgtgactatccttcatctacctaaaaagggggatgatgtgaaaccaggaaccatgtgccaagttgcagggtgggggaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttg

SEQ ID NO: 662 - DNA, 1483 bp, Homo sapiens
  Genbank Accession No. M19045
gggagcagtcaatatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 663 - DNA, 2570 bp, Homo sapiens
  Genbank Accession No. M19154
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcag

SEQ ID NO: 664 - DNA, 3583 bp, Homo sapiens
  Genbank Accession No. M19283
ggatccgcttggagcccgaggggaaagattgcaagggacgtcccagggagcaaagccccgcagcgtggccggggactcggggacccaccccagctccggcgcggccccgccccgggtcaggcagtttcggggcgcagcagggccctccccacggcgcggcagtcccggggagggccaggcccgtcagcccttcggccctcccggcgaccctcggagggcgccccaactcagacccgcccgccggcccgcgcagggtgccgagcgcgcgggggtggcgcgggcggggccgttgggaggcggtgcgggctgggggcggggcgggccggggccccacgtgtccctgcccggcgggccaatgggtgcccggctttcggaaagatcgccatatatggacatgttctggggccgcgcgcgccgccgggcgccgcgggcgcgccgcttccgcttaaataacggcgggggaggccgcggtcggtctcagtcgccgctgccagctctcgcactctgttcttccgcccctccgccgtcgcgtttctctgccggtgagcgccccgccccggggcctgagctggacgtcgcaggcctgcgccccccgaccccggctggccccgcttccagctgccgaggcctcgtcgcgccttccccgggaacaaaaggcggggtgggccgggtcaggcggacggggctgggggggcgccgggggtccagggcggggcccggccgcagtgcagacttccgagccgtggacgttacgtaaaaggcccggccttcggttccaggcggttgcgatcttggaggccacggccgctggggttggggcagggccgaggctgccccgcgggagggcattaggtggctgtggggaggggaccgtgttacagacgcgcccgcctgagtccatccttttccgggcaggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacggatcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggccgacgcccgtgctcctcccgtcctttccccagtcattttctcgcccggcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactctttcatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaaggtgagtcgaggggttggtggccctctgcctggctcgggagagctgactggggggcgctctgcgagctgaagccgtgcctggctgtctttgcagatcatcgcacccccagagcgcaagtactcagtgtggatcggcggctccatcctggcctcactgtccaccttccagcagatgtggattagcaagcaggagtacgacgagtcgggcccctccatcgtccaccgcaaatgcttctagacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattcaagttaactgttccccttggtatttgtttaataccctgtacatatctttgagttcaacctttagtacgtgtggcttggtcacttcgtggctgaggtaagaacgtgcttgtggaagacaagtctgtggcttggtgagtctgtgtggccagcagcctctgatctgtgcagggtattaacatgtcagggctgagtgttctgggatttctctagaggctggcaagaaccagttgtttttgtcttgcgggtctgtcagggttggaaagtccaagccgtaggacccagtttcctttcttagctgatgtctttggccagaacaccgtgggctgttaacttgccttgagttggaagcggtttgcatttacgcctgtaaatgtattcattcttaatttatgtaaggttttttttgtacgcaattctcgattctttaaagagatgacaacaaattttggttttctactgttatgtgagaatattaggccccagcaacacgtcattgtgtaaggaaaaataaaagtgctgccgtaaccaatgaatggctcctgtttggggaagtagcaagtgggctgggaaagacagaccaacctggaagtattgggtagtcttgggggtgggggcggtggctgctgctcagcttggcttcgtgggctggtgagaaaacggcttaacaataaactgagcagttcgatttcttccaaatcgaaagtgcaagaacaaggcagctagtgggtttgggtgttggaaataactgaagcaacatcataagcaggctgggagggaagtcctgagacggctttttccgttatt

SEQ ID NO: 665 - DNA, 980 bp, Homo sapiens
  Genbank Accession No. M19309
agcaaggctcagcctcaagattcacagcatctcagacgcagcctaggccgcaccaggatgtcggacaccgaggagcaggaatatgaggaggagcagccggaagaggaggctgcggacgaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacacc

SEQ ID NO: 666 - DNA, 3778 bp, Homo sapiens
  Genbank Accession No. M20543
ctgcgccctccggccgccggtggccctctgtgcggtgggggaaggggtcgacgtggctcagctttttggattcagggagctcgggggtgggaagagagaaatggagttccaggggcgtaaaggagagggagttcgccttccttcccttcctgagactcaggagtgactgcttctccaatcctcccaagcccaccactccacacgactccctcttcccggtagtcgcaagtgggagtttggggatctgagcaaagaacccgaagaggagttgaaatattggaagtcagcagtcaggcaccttcccgagcgcccagggcgctcagagtggacatggttggggaggcctttgggacaggtgcggttcccggagcgcaggcgcacacatgcacccaccggcgaacgcggtgaccctcgccccaccccatcccctccggcgggcaactgggtcgggtcaggaggggcaaacccgctagggagacactccatatacggcccggcccgcgttacctgggaccgggccaacccgctccttctttggtcaacgcaggggacccgggcgggggcccaggccgcgaaccggccgagggagggggctctagtgcccaacacccaaatatggctcgagaagggcagcgacattcctgcggggtggcgcggagggaatcgcccgcgggctatataaaacctgagcagagggacaagcggccaccgcagcggacagcgccaagtgaagcctcgcttcccctccgcggcgaccagggcccgagccgagagtagcagttgtagctacccgcccaggtagggcaggagttgggaggggacagggggacagggcactaccgaggggaacctgaaggactccggggcagaacccagtcggttcacctggtcagccccaggcctcgccctgagcgctgtgcctcgtctccggagccacacgcgctttaaaaaggaggcaagacagtcagcctctggaaattagacttctccaaatttttctctagccctttgggctcctttacctggcatgtaggatgtgcctagggagataaacggttttgctttagttgtcgccaaggcagttcccttccaaactagcgctagagcgaatgagcgagcagccaggaccaccattctgggtttccaacaggcgaaaaggccctttctgagtttgaaatgtcacagggttcctaacaggccactcttccctggatggggtgccaacgcctttcccatgggcatctccttccaccctcacgctggcccagcaagcaggcagtgctgaggccttatctccctaggtgacagatgtggtcagggaggcgcagagaggatgggcactagcgtccagctcctggaacaggtgtcaggcagggagggcagacaggtcttgggaacatgttcccctggctatgtggacagaggacttctcagtgggtctcgcgaccctgtgccccttttcctggttcagggcagccttagccggggcaaaggtcgagaagagaacccctggtcgccgccctggcagaatttgagtggctccggcaggagatgtccctaggttcctggggagggaggacgtcggggccagccaggcttacccccccctgccgctgagacttctgcgctgatgcacgcgcctcttcgcggtctccctgtccttgcagaaactagacacaatgtgcgacgaagacgagaccaccgccctcgtgtgcgacaatggctccggcctggtgaaagccggcttcgccggggatgacgcccctagggccgtgttcccgtccatcgtgggccgcccccgacaccaggtcaggctgcccctccgcagagggagccggctcggggtccccgcgtaagccagcctggtgccacccggagcggcgttaacgggtgcgtggtgtctcggctctgcagggcgtcatggtcggtatgggtcagaaagattcctacgtgggcgacgaggctcagagcaagagaggtatcctgaccctgaagtaccctatcgagcacggcatcatcaccaactgggatgacatggagaagatctggcaccacaccttctacaacgagcttcgcgtggctcccgaggagcaccccaccctgctcaccgaggcccccctcaatcccaaggccaaccgcgagaagatgacccagatcatgtttgagaccttcaacgtgcccgccatgtacgtggccatccaggccgtgctgtccctctacgcctccggaaggaccaccggtgagtgcccgctggcccccagtcccctcgtcccgcccccgcccccgcccccgcccccggccgctagcgctgagcgcctagcctcggcctcgcccccagccactcactctctcccgcgcgcgcacaggcatcgtgctggactccggcgacggcgtcacccacaacgtgcccatttatgagggctacgcgctgccgcacgccatcatgcgcctggacctggcgggccgcgatctcaccgactacctgatgaagatcctcactgagcgtggctactccttcgtgaccacaggtgcgcggcgcccctgcacccgggcggagggccgcggcggcctgagtgagggctcctctcctgcttctgccctccgcagctgagcgcgagatcgtgcgcgacatcaaggagaagctgtgctacgtggccctggacttcgagaacgagatggcgacggccgcctcctcctcctccctggaaaagagctacgagctgccagacgggcaggtcatcaccatcggcaacgagcgcttccgctgcccggagacgctcttccagccctccttcatcggtgagccccgctcgccctcgccccggcccccaggcccgcgccccccggcccgagcttctgctcacgctccccgccgcggtccccaggtatggagtcggcgggcattcacgagaccacctacaacagcatcatgaagtgtgacatcgacatcaggaaggacctgtatgccaacaacgtcatgtcggggggcaccacgatgtaccctgggatcgctgaccgcatgcagaaagagatcaccgcgctggcacccagcaccatgaagatcaaggtgggtggtggcctgcgcgggctgtcggcggggtgggctccagggtgaggtctccccacctcacgcgctgtcttgcagatcatcgccccgccggagcgcaaatactcggtgtggatcggcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcctctcaatgggggggcggctgagctccagccaccccgcagtcactttctttgtaacaactttccgttgctgccatcgtaaactgacacagtgtttataacgtgtacatacattaacttattacctcattttgttatttttcgaaacaaagccctgtggaagaaaatggaaaacttgaagaagcattaaagtcattctgttaagctgcgtaaagtggtcgtgtttatttgcttggggcgggagtggagcaggaagagggattcccatcccccacatcctcttaagtcacttttcacgataccccaaatgaatgggctccttggaagacaaaacttacatcttcccatgctccctgccggtttctgcagtggatcagatccattccagatcactggcagctagtggtggcctgacttgacctctggggtgtggcgaggcgagctttct

SEQ ID NO: 667 - DNA, 961 bp, Homo sapiens
  Genbank Accession No. M20642
cacagcccagtgtccttgaagatggacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctctttgacagaacaggtgattccaagatcaccttaagccaggtcggtgatgtccttcgagccctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaatgtctgctgctctagatgagaagaataaaatattgacaatctcaaatccaagcagccttctttattatctaccatgaatcaacgaaacattcttaaaacaataaatcaataaacaattttggtcagtctgaaaa

SEQ ID NO: 668 - DNA, 1160 bp, Homo sapiens
  Genbank Accession No. M21121
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 669 - DNA, 676 bp, Homo sapiens
  Genbank Accession No. M21494
acgaatgaacaggcattacctgtgtgcaggtaacctgttacacagtaggcactcactacatgcggctgttgcatttggcacgggggcacgtcccagcccctctgcaccttcgctgcctcttcacgcccctgtcccttgctcccacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccattgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctccccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggccttagctttgtgcgata

SEQ ID NO: 670 - DNA, 1688 bp, Homo sapiens
  Genbank Accession No. M21665
tcctcgctggagaagaccaagcaccggctacagaatgagatcgaggacttgatggtggacgtagagcgctccaatgctgctgctgctgctctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaacgtggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgcgccgtggtggagcagacagagcggtcccggaagctggcggagcaggagctgattgagactagtgagcgggtgcagctgctgcattcccagaacaccagcctcatcaaccagaagaagaagatggacgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagcgcctgaggtgccagcaaagccccatgctggagcctgtgtaacagctcgcttgggaggaagcagaataaagcaatttccttgaagccg

SEQ ID NO: 671 - DNA, 229 bp, Homo sapiens
  Genbank Accession No. M22406
ctgcacccaaacagacacatcaacgcaccccactcacagacaccccttaccccacccccactgtgcagagaccaaccatgacacccatcaccaccaccaccacggtgaccccaaccccaacacccaccggcacacagaccccaacaacgacacccatcagcaccaccaccacggtgaccccaaccccaacacccaccggcacacagaccccaagatcgacacccatcac

SEQ ID NO: 672 - DNA, 1568 bp, Homo sapiens
  Genbank Accession No. M24069
gaattcgggcgggggagcccaaggagcgagcgcgccagacgaagctcgagccgcctccgccagcgcgaccccacctcggccgccggcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccctgcagccacgggcaccgcggccgccgcctctttagccgccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgccgtcctcctaacgctccttcacaagatggcaaagaggccaaggcaggtgaagcaccaactgagaaccctgctccacccacccagcagagcagtgtgagtaacaccaggctcctcaggcaccttcaccatcggcaggtggacctaaagaattagatgaccattcagaaataaagcaaaaagcaggccacataccttaaccaacaccaaagaaacatccaagcaataaagtggaagactaaccaagatttggacattggaatgtttactgttattctttaagaaacaactacaaaaagaaaatgtcaacaaatttttccagcaagctgagaacctggaattc

SEQ ID NO: 673 - DNA, 565 bp, Homo sapiens
  Genbank Accession No. M26311
aattcgctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccatggccacagtcatggtggccacggccacaggccactaatcaggaggccaggccaccctgcctctacccaaccagggccccggggcctgttatgtcaaactgtcttggctgtggggctaggggctggggccaaataaagtctcttcctccaagct

SEQ ID NO: 674 - DNA, 213 bp, Homo sapiens
  Genbank Accession No. M28590
ccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaa

SEQ ID NO: 675 - DNA, 1045 bp, Homo sapiens
  Genbank Accession No. M29645
caggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggccaggcgaccccagcgctcccagaactgaggctggcagccagccccagcctcagccccaactgcgaggcagagagacaccaatgggaatgccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacaccttcacatacct

SEQ ID NO: 676 - DNA, 1586 bp, Homo sapiens
  Genbank Accession No. M30894
gaatcaggaagaccagctcctcctactgtcttctgtgttacgggatcagcgttccttgttgagtgggacctgagttttgagagggtcttctgctcctcttggtctggtcccttacttccaagagccccagagaggaaggcatgctgttggctctagctctgcttctagctttcctgcctcctgccagtcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctggaaggattattataagaaactctttggcagtggaacaacacttgttgtcacagataaacaacttgatgcagatgtttcccccaagcccactatttttcttccttcgattgctgaaacaaaactccagaaggctggaacatatctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaagacagttattcaaaagatgcaaatgatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcagtctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaattt

SEQ ID NO: 677 - DNA, 1922 bp, Homo sapiens
  Genbank Accession No. M31776
ctgtgagatcaccccgtgctcccagcgctcacgtcggtcctcggaaagccggggtcctccctgccttttccagcaacggtggggtggggaggcaggaagaaagcgccaacctaggaccccggagatttgcagcaaaggaagaagcgggagacgggcacttgtctgtgtctccagcgcgttcctgccccccgccgacccggcccatttctatacaaggtcgctctgcccggtctccacctcccacgtgcaggccgcggaggggctcattcccgggccctgatctcagaggcccggaatgtggctgataaatcagagactagacctgcatggcaggcaggcccgacactcagctccaggataaaaggccacggtgtcccgaggagccaggaggagcaccccgcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggtgagagcggagggcagctcagggggattggacagcagcaatgaaagggtcctcacctgctgtcccaagaggccctcatctttcctttggaattagtgataaaggaatcagaaaatggagagactgggtgccctgaccctgtacccaaggcagtcggttcacttgggtgccatgaagggctggtgagccaggggtgggtccctgaggcttggacgcccccattcattgcaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaaggtaagcaccccctgccaccccggccgccttcccccattccagtgtgtgacactgttagagtcactttggggtttgttgtctctgggaaccacactctttgagaaaaggtcacctggacatcgcttcctcttgttaacagccttcagggccaaggggtgcctttgtggaattagtaaatgtgggcttatttcattaccatgcccacaataccttctccccacctcctacttcttatcaaaggggcagaatctcctttgggggtctgtttatcatttggcagccccccagtggtgcagaaagagaaccaaacatttcctcctggtttcctctaaactgtctatagtctcaaaggcagagagcaggatcaccagagcaatgataatccccaatttacagatgaggaaactgaggctcagagagttgcattaagcctcaaacgtctgatgactaacagggtggtgggtggcacacgatgaggtaagctcagcccctgcctccatctcccaccctaaccatcatcaccctctctctttccctgacagtgctgaggcggcattaagaggaagtcctggctgcagacacctgcttctgattccacaaggggctttttcctcaaccctgtggccgcctttgaagtgactcattttttttaatgtatttatgtatttatttgattgttttatataagatggtttcttacctttgagcacaaaatttccacggtgaaataaagtcaacattataagctttatcttttgaaactgatttgtcttggcgcattaaaaataatccctcatttcaaagaa

SEQ ID NO: 678 - DNA, 700 bp, Homo sapiens
  Genbank Accession No. M31994
ttctctctaggggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgattttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaatttttttaagtacaagttttggtcacagtgatttcttcttgtcacttaaaaacagtgttaaa

SEQ ID NO: 679 - DNA, 1268 bp, Homo sapiens
  Genbank Accession No. M33197
gttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 680 - DNA, 1081 bp, Homo sapiens
  Genbank Accession No. M33493
gctgcccgtcctggcgagccgcgcctacgcggcccctgccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaaggtctccagccacgtccacacggtcaccctgccccctgcctcagagaccttccccccggggatgccgtgctgggtcactggctggggcgatgtggacaatgatgagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggaggaccagcccctcctgtccaaaacaccactgcttcctacccaggcggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcc

SEQ ID NO: 681 - DNA, 1631 bp, Homo sapiens
  Genbank Accession No. M33552
tttaacacccatagtaggcctaaaagcagccaccaattaagaaagccacagcacgtacacccactccagggatctgccagcaccctgtggggcccagactacaggctgatggcggaggcttcgagtgacccgggtgctgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctc

SEQ ID NO: 682 - DNA, 1056 bp, Homo sapiens
  Genbank Accession No. M33653
agatccggacgctggccttgatggggcctcttggtcttcttgggcaaattggcccacttggagctctagggatgctaggccagaagggggagattggactgctaggccctctaggacacgatgggaaaggacctcgcggtaaactaggagacatgggccctcttggtccccaaggccccctaggaaaggatggacctccaggagtgaagggagaaaacgggcacccagggagcccaggagagaagggggaaaaaggggagacaggacaagcaggctcaccggttcctgggctgctagggccagaggggcctcccggacctccggggctccaaggtgttcctggaccaaagggggaagcaggactagacggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggacaagggagaccaaggagcgcctggattagatgccccctgcccattggggcaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaaccgttgcatattttgtacagaaaatatcaacctcttcccttttgtttacaagatgttttgtataagcctatgtctctaatacattttttgtttggtcgtaatgtctgcatgatatttgtgcacatttattaagtatcgaaggttaataaattgttgtgtcctggtgccaaggggggccagccagaactg

SEQ ID NO: 683 - DNA, 1238 bp, Homo sapiens
  Genbank Accession No. M34338
cggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcgctgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaaggtgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgcgagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccccg

SEQ ID NO: 684 - DNA, 468 bp, Homo sapiens
  Genbank Accession No. M34516
tcctctgtccacacaggtcagcccaaggccaccccctcggtcactctgttcctgccgtcctctgaggagctccaagccaacaaggccacactggtgtgtctcatgaatgacttctatctgggaatcttgacggtgacctggaaggcagatggtacccccatcacccagggcgtggagatgaccacgccctccaaacagagcaacagcaagtacatggccagcagctacctgagcctgacgcccgagcagtggaggtcccgcagaagctacagctgccaggtcatgcacgaagggagcactgcagagaagacggtggcccctgcagaatgttcataggttcccagcccccagcccacccacaggaggcctggagctgcaggatcccaggggaggggtctctctccccatcccaagtcatccagcccttctccctgcactcatgaaaccccaataaatatcctcattgac

SEQ ID NO: 685 - DNA, 1060 bp, Homo sapiens
  Genbank Accession No. M34996
gccctgaccaccgtgatgagcccctgtggaggtgaagacattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgcgccctggggttgtctgtgggcctcgtggcctttgtggtgggcactgtcttcatcatccaaggcctgcgttcagttggtgcttccagacaccaagggccattgtgaatcccatcctggaagggaaggtgcatcgccatctacaggagcagaagagtggacttgctacatgacctagcactattctctggccccgatttatcatatcccttttctcctccaaatatttctcctctcaccttttctctgggacttaagctgctatatcccctcagagctcacaaatgtctttacattctttccctgacctcctgattttttttttcttttctcaaatgttacctacaaagacatgcctggggtaacccagccggctacctaattcctcagtaacctccatctataatctccaaggaagcaacaaattccttttatg

SEQ ID NO: 686 - DNA, 1104 bp, Homo sapiens
  Genbank Accession No. M35252
ctctagagtcgagatccattgtgctctaaagtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttaaaaaaaaaaaaaaaaaaaaa

SEQ ID NO: 687 - DNA, 1058 bp, Homo sapiens
  Genbank Accession No. M37766
gggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcaccgtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaa

SEQ ID NO: 688 - DNA, 4567 bp, Homo sapiens
  Genbank Accession No. M37984
cctcgcccgccccgcgcgtgactgacagggccactcagggcgcgcgtgcgaggtgctcgcttgggtaatctacctgcgtgggcccgccggcggtaccctgcacagcctgctagaaactgagaccccgggtggtgacagctctggcatcgcccctgggtcctcgggaagaggggacagaaggtcccgagtctcccaggccacacgaagcaagtcactgctcttcctggcctcagtttactcctcctgataaaggaggccataatagtgcctcacctggctgttggctctttctctttagggcaaggcaggttggaggggaaaataggacctgtgcttaccgccggagcagggcgagagtgattctgggccagttctgaacctctctgagattcggagatctcttgtcagtggggcttctggacaactgagtgggctgattgatgcgcggcccagcacgcggcccagtgctcgaggcagggagcgtgtttatcaagagggataaacttgatacgaactctgtacgaaggaaggtgtaggtggatggaggggtgtgtgctgccactgagcacaagaacccacggggtggcctgccaaagttcaaaacgagggagacaggttgatctggacccaggaactacagtgctgaatcctaaaccggggaaagatgagacctagaagagggaggtggtaacctaattggagggtgaggagggaaagagcctgccacagatggggcatctataggggtgctgttgataacagagcagctgacttaagcccgaagtgggtacttctccctgggcagatgggaggtctgggacaggctcctctggcagaagggctcctggccaccctgtcctaaggtgggtcagtcacttcctccttcaccagttccacagcatcttactatgagcttggcattcgaggcttctcttggcagggccctgcactcctagcctctccttgcacattgcacccccattccagagaggtttagttaaaggcgggggttaccaagtcagtcagatcttgggcaagtcaccactcctccagagcctcagtttccttatctggaaagtggaggtcatggcaacccgccaacctggttggatgggagcctgagctgttgtgttgcaccttgcctggggcccacgactttgtagctcctgtcctgcactgggcttatgttttcattcattccagaaaccttttcagagagtccctttggggagtgtgggggacaggagggaaagaaacctggtccttgtagccgttcgtctgctccctgccctgggcagaggacatggggactcaggccagcctgagatcactgggaccagaggaggggctggaggatactacacgcaggggtgggctgggctgggctgggctgggccaggaatgcagcggggcagggctatttaagtcaagggccggctggcaaccccagcaagctgtcctgtgagccgccagcatggatgacatctacaaggctgcggtgagggacagggctgggtagggctggggtgggcaggcccactgggggctcactcagctgagagtgcggggttagtagccccagggaagtggtggggaccaaggagaaggcctacgtgccttcaacccaggccctcacagggacagtgattctggtgtttgaggatgcagaagggggtagggggttccgggtctgaagggtggtggaggaggttgcagctttctgatcgtgtctcactctctgtttccaagtgtctgtggtctgtggcactgtcgctcagccacatgtctctgcatttgtctctggacgtttttgccttcctcttttcatctcttcctcctgagctgtctgagtccccattactgtctccctgtccccaacccccactttctgcccctcacattctgcttctcacatgctcaaaatctgccacccactccagcccttggcgggccgaagatgcttggagggtggagggtgtgagaggaggggtctgtagagcctgagtcctgggctggagatggggctttgaagtttgaggcagggaagttctggacatgagggagaaccaaggaagaaggaacagagaactggggccccagctcccatcatgcctggcaggctcagggctcagtggcttagctaggggtgagagcgagggaatgagggctggagagtggtcaccccaagcccctgcaacctcctgggtcactgagggtcttcagatgctattctatcctgggtggtggtacctccccaacccagagcaaggacatcctggcatggccagctgtccccaggggaacccctccctcagcctccctcactcctgggcagggaagtgctatagccagctctgggggcacgcctgcttatcctgtgggagtccatggagccggggtggggacagccctccacccagtgcccatacaaggcctggcggagttggggactaattttggcttctgaggcggcactagcagccagggggccagataacgctgccccctgcatgccaaagtccccagaacaatcaccaggtttcactttgttcctcgttaaaaatagcccagtggccaccctggtcaggttaccgtgggtggcttgcctgcctccacactggttttattatcccaacttagggacagctgtccttccggcccacccagcttgagtttcatcaggggccgaaagggcattgagtggtcactgactattgttactgagggtcaccttggtcctgaagggggtgcccacctgtcaccctggccctgagcccagtcgcagtgaggccagctgggtcacgtcagggctttgggggcagggagggaggactgagacctccactctgtggcctggaaatagccagcctcctccagctccagccttctcacctgtggaatgggttggttcctacgcagcagctatacctgagtctgagaccttgagattccctttccttctaggtagagcagctgacagaagagcagaaaaatggtgagaatccctatcacacatgtgggagaccagcgggtccaggctggcatggggaccccttatcagaagaggaccccaggccagagaccagaggcttggtccctcttgctctgccctcagagaggtctccgagggaggtgggcaggttggcaggtggccccagggttctggccctccgtggtcctggctgctgagccctgactaccgtgccccccaacccctgaacacagagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggtgagcccccctcctccccaggctccagaagaaccccagctggctgggggctggaatgctggctctgtttagctgggagcaatttagcctatccgagccttggttgcctcatctataaaatgggcataagggctacacaagcctggcgtttggtgtgaggatgcggtgagaacatgggggttcgtgtcgaaggtgctgcctgcagtacctaccctggcctctgtaacggccatgctgcccacccccaggcagcggcacggtggactttgatgagttcctggtcatgatggttcggtgcatgaaggacgacagcaaagggaaatctgaggaggagctgtctgacctcttccgcatgtttgacaagtgagcacgtgacccttgacctctgaccctgacccacactcaagccgagctgtacaggagggcagtctcagattccaggcctagggaccctgtggcctctgcctgataggggagagggatgccccatctcccagtgtccctgctctgcctcctggggcatgggtggggctgcctcatgccctccccacagccctaccctgagccccctccccacagaaatgctgatggctacatcgacctggatgagctgaagataatgctgcaggctacaggcgagaccatcacggaggacgacatcgaggagctcatgaaggacggagacaagaacaacgacggccgcatcgactatgatggtaagcgggtgggtgggctgatctcctgcctccatgccctgcccagcccctaccctcaacccacacctgcccctctttccacagagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaggtctgctatctggctctggtgtccctgggccgtggactcatccccaggacccactcttacccaatggccgcttccttccctgtcctaggcaggctggctgcagagcctggcgcctgaccaccgctccacactgccttctgcaggggggtgagatgagatcggagactgccgtgtggcctgccctgct

SEQ ID NO: 689 - DNA, 2938 bp, Homo sapiens
  Genbank Accession No. M54927
gagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcccgtgtacatttacttcaacacctggaccacctgcgactctattgccttccccagcaagacctctgccagtataggcagtctctgtgctgacgccagaatgtatggtgttctcccatggattgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccgtagaaatccccctttctctaatagcgaggctctaaccacacagcctacaatgctgcgtctcccatcttaactctttgcctttgccaccaactggccctcttcttacttgatgagtgtaacaagaaaggagagtcttgcagtgattaagtctctctttggactctcccctcttatgtacctcttttagtcattttgcttcatagctggttcctgctagaaatgggaaatgcctaagaagatgacttcccaactgcaagtcacaaaggaatggaggctctaattgaattttcaagcatctcctgaggatcagaaagtaatttcttctcaaagggtacttccactgatggaaacaaagtggaaggaaagatgctcaggtacagagaaggaatgtctttggtcctctcgccatctataggggccaaatatattctctttggtgtacaaaatgaattcattctggtctctctattaccactgaagatagaagaaaaaagaatgtcagaaaaacaataagagcgtttgcccaaatctgcctattgcagctgggagaagggggtcaaagcaaggatctttcacccacagaaagagagcactgaccccgatggcgatggactactgaagccctaactcagccaaccttacttacagcataagggagcgtagaatctgtgtagacgaagggggcatctggccttacacctcgttagggaagagaaacagggtgttgtcagcatcttctcactcccttctccttgataacagctaccatgacaaccctgtggtttccaaggagctgagaatagaaggaaactagcttacatgagaacagactggcctgaggagcagcagttgctggtggctaatggtgtaacctgagatgccctctggtagacacaggatagataactctttggatagcatgtctttttttctgttaattagttgtgtactctggcctctgtcatatcttcacaatggtgctcatttcatggggtattatccattcagtcatcgtaggtgatttgaaggtcttgatttgttttagaatgatgcacatttcatgtattcccagtttgtttattacttatttgggttgcatcagaaatgtctggagaataattctttgattatgactgttttttaaactaggaaaattggacattaagcatcacaaatgatattaaaaattggctagttgaatctattgggattttctacaagtattctgcctttgcagaaacagatttggtgaatttgaatctcaatttgagtaatctgatcgttctctctagctaatgggaaaatgattttacttagcaatgttatcttggtgtgttaagagttaggtttaacataaaggttattttctcctgatatagatcacataacagaatgcaccagtcatcaggctattcagttggtaagcttccaggaaaaaggacaggcagaaacgagtttgagacctgaatagctcccagatttcagtcttttcctgtttttgttaactttgggttaaaaaaaaaaaaaagtctgattggttttaattgaaggaaagatttgtactacagttcttctgttgtaaagagttgtgttgttcttttcccccaaagtggtttcagcaatatttaaggagatgtaagaggctttacaaaaaaacacttgatacttgttttcaaaccagtatacaagataagcttccaggctgcatagaaggaggagagggaaaatgttttgtaagaaaccaatcaagataaaggacagtgaagtaatccgtaccttgtgttttgttttgatttaataacataacaaataaccaacccttccctgaaaacctcacatgcatacatacacatatatacacacacaaagagagttaatcaactgaaagtgtttccttcatttctgatatagaattgcaattttaacacacataaaggataaacttttagaaacttatcttacaaagtgtattttat

SEQ ID NO: 690 - DNA, 1104 bp, Homo sapiens
  Genbank Accession No. M57466
tgcagcacctatttccaattgtgtatggcctcgagtaccaggtctcgcctccaggatggtcctgcaggtttctgcggccccccggacagtggctctgacggcgttactgatggtgctgctcacatctgtggtccaaggcagggccactccagagaattacgtgcaccagttacggcaggaatgctacggctttaatgggacacagcgcttcctagagagttacatctacaaccgggaggagttcgtgcgcttcgacagcgacgtgggggagttccgggcggtgacggagctggggcggcctgatgaggactactggaacagccagaaggacatcctggaggaggagcgggcagtgccggacagggtatgcagacgcaactacgagctggacgaggccgtgaccctgcagcgccgagtccagcctaaggtgaacgtttccccctccaagaaggggcccctgcagcaccacaacctgcttgtctgccacgtgacagatttctacccaagcagcattcaagtccgatggttcctgaatggacaggaggaaacagctggggtcgtgtccaccaacctgatccgtaatggagactggaccttccagatcctggtgatgctggaaatgaccccccagcagggagacgtctacatctgccaagtggagcacaccagcctggacagtcctgtcaccgtggagtggaaggcacagtctgattctgcccagagtaagacattgacgggagctgggggcttcgtgctggggctcatcatctgtggagtgggcatcttcatgcacaggaggagcaagaaagttcaacgaggatctgcataaacagggttcctgacctcaccgaaaagactaatgtgccttagaacaagcatttgctgtgttttgttaagtagtggttccaggacagaccctcagcttcccaagaggaaactgctgccaagaagttgctctgaaggcagtttctatcgttctgcgctttgattcaaagcactgtttctctcactgggcctccaaccatgttcccttcttcttagcaccacaaataatcaaaacccaacataagtgtttgttttcctttaaaaatatgcatcaaaaaa

SEQ ID NO: 691 - DNA, 4426 bp, Homo sapiens
  Genbank Accession No. M59465
tgccttgaccaggacttgggactttgcgaaaggatcgcggggcccggagaggtgttggagagcacaatggctgaacaagtccttcctcaggctttgtatttgagcaatatgcggaaagctgtgaagatacgggagagaactccagaagacatttttaaacctactaatgggatcattcatcattttaaaaccatgcaccgatacacactggaaatgttcagaacttgccagttttgtcctcagtttcgggagatcatccacaaagccctcatcgacagaaacatccaggccaccctggaaagccagaagaaactcaactggtgtcgagaagtccggaagcttgtggcgctgaaaacgaacggtgacggcaattgcctcatgcatgccacttctcagtacatgtggggcgttcaggacacagacttggtactgaggaaggcgctgttcagcacgctcaaggaaacagacacacgcaactttaaattccgctggcaactggagtctctcaaatctcaggaatttgttgaaacggggctttgctatgatactcggaactggaatgatgaatgggacaatcttatcaaaatggcttccacagacacacccatggcccgaagtggacttcagtacaactcactggaagaaatacacatatttgtcctttgcaacatcctcagaaggccaatcattgtcatttcagacaaaatgctaagaagtttggaatcaggttccaatttcgcccctttgaaagtgggtggaatttacttgcctctccactggcctgcccaggaatgctacagataccccattgttctcggctatgacagccatcattttgtacccttggtgaccctgaaggacagtgggcctgaaatccgagctgttccacttgttaacagagaccggggaagatttgaagacttaaaagttcactttttgacagatcctgaaaatgagatgaaggagaagctcttaaaagagtacttaatggtgatagaaatccccgtccaaggctgggaccatggcacaactcatctcatcaatgccgcaaagttggatgaagctaacttaccaaaagaaatcaatctggtagatgattactttgaacttgttcagcatgagtacaagaaatggcaggaaaacagcgagcaggggaggagagaggggcacgcccagaatcccatggaaccttccgtgccccagctttctctcatggatgtaaaatgtgaaacgcccaactgccccttcttcatgtctgtgaacacccagcctttatgccatgagtgctcagagaggcggcaaaagaatcaaaacaaactcccaaagctgaactccaagccgggccctgaggggctccctggcatggcgctcggggcctctcggggagaagcctatgagcccttggcgtggaaccctgaggagtccactggggggcctcattcggccccaccgacagcacccagcccttttctgttcagtgagaccactgccatgaagtgcaggagccccggctgccccttcacactgaatgtgcagcacaacggattttgtgaacgttgccacaacgcccggcaacttcacgccagccacgccccagaccacacaaggcacttggatcccgggaagtgccaagcctgcctccaggatgttaccaggacatttaatgggatctgcagtacttgcttcaaaaggactacagcagaggcctcctccagcctcagcaccagcctccctccttcctgtcaccagcgttccaagtcagatccctcgcggctcgtccggagcccctccccgcattcttgccacagagctggaaacgacgcccctgctggctgcctgtctcaagctgcacggactcctggggacaggacggggacgagcaagtgcagaaaagccggctgcgtgtattttgggactccagaaaacaagggcttttgcacactgtgtttcatcgagtacagagaaaacaaacattttgctgctgcctcagggaaagtcagtcccacagcgtccaggttccagaacaccattccgtgcctggggagggaatgcggcacccttggaagcaccatgtttgaaggatactgccagaagtgtttcattgaagctcagaatcagagatttcatgaggccaaaaggacagaagagcaactgagatcgagccagcgcagagatgtgcctcgaaccacacaaagcacctcaaggcccaagtgcgcccgggcctcctgcaagaacatcctggcctgccgcagcgaggagctctgcatggagtgtcagcatcccaaccagaggatgggccctggggcccaccggggtgagcctgcccccgaagacccccccaagcagcgttgccgggcccccgcctgtgatcattttggcaatgccaagtgcaacggctactgcaacgaatgctttcagttcaagcagatgtatggctaaccggaaacaggtgggtcacctcctgcaagaagtggggcctcgagctgtcagtcatcatggtgctatcctctgaacccctcagctgccactgcaacagtgggcttaagggtgtctgagcaggagaggaaagataagctcttcgtggtgcccacgatgctcaggtttggtaacccgggagtgttcccaggtggccttagaaagcaaagcttgtaactggcaagggatgatgtcagattcagcccaaggttcctcctctcctaccaagcaggaggccaggaacttctttggacttggaaggtgtgcggggactggccgaggcccctgcaccctgcgcatcaggactgcttcatcgtcttggctgagaaagggaaaagacacacaagtcgcgtgggttggagaagccagagccattccacctcccctcccccagcatctctcagagatgtgaagccagatcctcatggcagcgaggccctctgcaagaagctcaaggaagctcagggaaaatggacgtattcagagagtgtttgtagttcatggtttttccctacctgcccggttcctttcctgaggacccggcagaaatgcagaaccatccatggactgtgattctgaggctgctgagactgaacatgttcacattgacagaaaaacaagctgctctttataatatgcaccttttaaaaaattagaatattttactgggaagacgtgtaactctttgggttattactgtctttacttctaaagaagttagcttgaactgaggagtaaaagtgtgtacatatataatatacccttacattatgtatgagggatttttttaaattatattgaaatgctgccctagaagtacaataggaaggctaaataataataacctgttttctggttgttgttggggcatgagcttgtgtatacactgcttgcataaactcaaccagctgcctttttaaagggagctctagtcctttttgtgtaattcactttatttattttattacaaacttcaagattatttaagtgaagatatttcttcagctctggggaaaatgccacagtgttctcctgagagaacatccttgctttgagtcaggctgtgggcaagttcctgaccacagggagtaaattggcctctttgatacacttttgcttgcctccccaggaaagaaggaattgcatccaaggtatacatacatattcatcgatgtttcgtgcttctccttatgaaactccagctatgtaataaaaaactatactctgtgttctgttaatgcctctgagtgtcctacctccttggagatgagatagggaaggagcagggatgagactggcaatggtcacagggaaagatgtggccttttgtgatggttttattttctgttaacactgtgtcctgggggggctgggaagtcccctgcatcccatggtaccctggtattgggacagcaaaagccagtaaccatgagtatgaggaaatctctttctgttgctggcttacagtttctctgtgtgctttgtggttgctgtcatatttgctctagaagaaaaaaaaaaaaggaggggaaatgcattttccccagagataaaggctgccattttgggggtctgtacttatggcctgaaaatatttgtgatccataactctacacagcctttactcatactattaggcacactttccccttagagccccctaagtttttcccagacgaatctttataatttcctttccaaagataccaaataaacttcagtgttttcatctaattctcttaaagttgatatcttaatattttgtgttgatcattatttccattcttaatgtgaaaaaaagtaattatttatacttattataaaaagtatttgaaatttgcacatttaattgtccctaatagaaagccacctattctttgttggatttcttcaagtttttctaaataaatgtaacttttcacaagagtcaacattaaaaaataaattattt

SEQ ID NO: 692 - DNA, 2153 bp, Homo sapiens
  Genbank Accession No. M60314
ctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggtttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaatagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggagattataacacaagtgagcaaaaacaagcctgtaagaagcacgaactctatgtgagcttccgggatctgggatggcaggactggattatagcaccagaaggatacgctgcattttattgtgatggagaatgttcttttccacttaacgcccatatgaatgccaccaaccacgctatagttcagactctggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacagaaaaaaaaa

SEQ ID NO: 693 - DNA, 1818 bp, Homo sapiens
  Genbank Accession No. M60459
tcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttg

SEQ ID NO: 694 - DNA, 1568 bp, Homo sapiens
  Genbank Accession No. M61764
cgcaacgccggtgcctgaggagcgatgccgagggaaatcatcaccctacagttgggccagtgcggcaatcagattgggttcgagttctggaaacagctgtgcgccgagcatggtatcagccccgaggcgatcgtggaggagttcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggagaaaagatccatgaggacatttttgacatcatagaccgggaggcagatggtagtgacagtctagagggctttgtgctgtgtcactccattgctggggggacaggctctggactgggttcctacctcttagaacggctgaatgacaggtatcctaagaagctggtgcagacatactcagtgtttcccaaccaggacgagatgagcgatgtggtggtccagccttacaattcactcctcacactcaagaggctgacgcagaatgcagactgtctggtggtgctggacaacacagccctgaaccggattgccacagaccgcctgcacatccagaacccatccttctcccagatcaaccagctggtgtctaccatcatgtcagccagcaccaccaccctgcgctaccctggctacatgaacaatgacctcatcggcctcatcgcctcgctcattcccaccccacggctccacttcctcatgaccggctacacccctctcactacggaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcttgcagaggatccgggaacgcaagttggccaacttcatcccgtggggccccgccagcatccaggtggccctgtcgaggaagtctccctacctgccctcggcccaccgggtcagcgggctcatgatggccaaccacaccagcatctcctcgctcttcgagagaacctgtcgccagtatgacaagctgcgtaagcgggaggccttcctggagcagttccgcaaggaggacatgttcaaggacaactttgatgagatggacacatccagggagattgtgcagcagctcatcgatgagtaccatgcggccacacggccagactacatctcctggggcacccaggagcagtgagtcccccaggacaggggaccctcatctgccttactggttggcccaagccctgcctgactgaccaccccctcagagcacagatcagggacctcacgcatctctttctcatatacatggactctctgttggcctgcaaacacatttacttctcctcttatgagactatttatctttaataaagcactggg

SEQ ID NO: 695 - DNA, 1811 bp, Homo sapiens
  Genbank Accession No. M62831
ggtttgtgtagagaggcgtgcagagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgttggactggtcccgagcaagaaagcccgtctggaagaaaaggaagaagaggagggagcgtcatccgaagtcgccgatcgcctgcagccccctccgggccaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagaggactctgtccccggggagccatcgccttcagtgtgcagggacggcaccgaggagtctgagccgggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttggctgggtgtgggcctggaggaaggtcctggggcgtgcactcgcctgggcagtggggaggagagtggcctgagttacttcacccccgcgtgctgctggttaatgtcccgcgtctctgcaccttcgggtgggagcggggactgatctactttcacattctcaagtttttctcatctgcattagaggtccccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagt

SEQ ID NO: 696 - DNA, 1244 bp, Homo sapiens
  Genbank Accession No. M63438
atggaagccccagctcagcttctcttcctcctgctactctggctcccagataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 697 - DNA, 893 bp, Homo sapiens
  Genbank Accession No. M63573
gggtttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaatataaaaaaacccccc

SEQ ID NO: 698 - DNA, 2156 bp, Homo sapiens
  Genbank Accession No. M64673
cgggcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctaaaaaaaaaaaaaaaaaaaa

SEQ ID NO: 699 - DNA, 4732 bp, Homo sapiens
  Genbank Accession No. M68519
tccagcctgagtgttctgcagggaaatgtgctgtgtaaacactatgcctatttcctgcttggagaacaggttttgaggtagagctctcaggggtggggaagaagcctggcagcccacatgctataaatgctgttgtccacctttatgctctaacttggaggcagagacccaagcagctggaggctctgtgtgtgggtgagtttagccacatcccctaggtgttctccagcttgaggatcgcaggcagagaggaccagcccagcagccacaggcctgaccaaggccaggttgggaaggagggcaactccccattttccactgggaggtgtttcacagcatggtcaacatggatgacctacaaagaccctcatgctttgatatcttccttggccagatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaaggtaactgggcatatgagggacagatggagtgagtcagtgagtgagtgacctcatccttcctcctaacagcctgggagggacagggcaggttttctgcagagcatggaagattcagctgaaatcagagaggtgaagccagtttcccagggtaacatagtgaggcactgaaagaaaggagactgcactgagcccaggtccctgggctccccagagctccttactcttcctcctcctcagcagccttgagaccccacaacctccagccggaggcctgaagcatgaggccatgccaggtgccagatgatgcttggaattttcccgggtgcttcgggtcttcccagcactctggtctcgcccgccctgcctctcgctctgcccagcttcctgagtcctgacagagcacagtgggggaagatgttggcagaggtggcagatgggctcacggccatccctccagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggtactgtgctgcagaccccaccctcagctgagggacacagaccccttttcaggaggcccatctgtccaggcccctaggctgtgggccatagtgagctgggggctatagtaagctgggtgggacttcagtctgcagggctggtgggttcctggggcccttatgatggcgcatcctggagagtctgtcctcatagtgcccacggagtgatagctgagccagccccggtgataatgggcatcgagtctcattagctccaaccagttgtgggtgacagatcctacacatccatgtctcttttctctgcaggccccatgggtccgcctggagaaacaccatgtcctcctgggaataatgggctgcctggagcccctggtgtccctggagagcgtggagagaagggggaggctggcgagagaggccctccaggtgagcagggcgggcaggtgggcagtggaaacatgggcacagcgacctgaagtcagttacacaggggtgatgggggtcagacaaaccctgcaggtaccccaagggcatttggctcaacctaagtaagagaatatgaatttgagggagaaagccgaggtgtctggggagtgtggtcacaattcagagaagggcaggtgtgggaagtcctccgtgcctcatgaccgctgatggggacacactgagtcaggtgtgggacgagggacagctctgggaggcaggggaggcatgtcctgggatggagccctgggggcagtctgaagggtgaatgcggacgaggcatccaggcagatggtgtgatcaggagccccacagacagaggggaactttgaagctcagagcggtaagcaagtccatcagggcagtgcagagagcatcatgcttgcccttggtggagggtgcgggagagggacttgccccacagaggcgggcagacagaacccctcgagggacagagcaggaaagaggacaaggggtgggggtctcagcaggggcaaggcttcactaaagaataggggaccacggggtgtggagacacactggaatctcgtggaccctctgagcctagggtctgggtggtgcctaacagcaatgaaagggcagagttccaggattgcagatggcaaaacgcctgcgtggcagcaagtgggagtcttcactggcctgcccctccttctgtgtggggcactctccacagggcttccagctcatctagatgaggagctccaagccacactccacgacttcagacatcaaatcctgcagacaaggggaggtaaggggaccccctgggcctcacggggtaggagtttcccacaaattcccctcattctcagcaccaccttctagaatagagatgacaaacaagcgtgcacatgcaggtgttggggaaaggaatgatgcttgcttttctgatgtctttgaatggccaagaggagacaagcagacacaattcactccccatttcataagaaagcaagttctctgcctgtcttgctttccactgaatcctaggaaattgcaccatttctggcaataagtaattgttacttagatgaatgaataaatggaggagagtctaaaagtgaatttagaaaactgcaattggaagaggaagagaagacacagagagaggcagagatggagagactggggaggatctggtagcagagaccctaggtgagggaggtggcttagagacaaagtggtcagtggcctgacctggactcctctgctctcagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgatttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcttccttattccccatctggtccagttccttcacttacagatggcagcagtgaggccttggggtagaaggatcctccaaagtcacacagagtgcctgcctcctggtcccctcagctctgcctctgcagcccactgcctgcccagagccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccatagctttggttccaagaaacatcacatttctg

SEQ ID NO: 700 - DNA, 1121 bp, Homo sapiens
  Genbank Accession No. M68864
ggaattccctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccagggcatcgaggctgcgatggactggctgatggagcacgaagacgaccccgatgtggacgagcctttagagactccccttggacatatcctgggacgggagcccacttcctcagagcaaggcggccttgaaggatctgcttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgctgaggagaggcggagggaaaatgccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgt

SEQ ID NO: 701 - DNA, 3233 bp, Homo sapiens
  Genbank Accession No. M73077
cttgaagtggtttgttgtgcttgaagagaccccatggatgccaccagtcacattgacaacatggaaaacgaacggattccctttgatttaatggataccgtccctgcagaggcactatacgaggcccacttagagaagctgaggaacgaaaggaaaagagttgagatgcgaagggcgtttaaagaaaacctggagacttctcctttcataactcccggaaagccttgggaagaggcccgtagttttattatgaatgaggatttctaccagtggctggaggaatctgtatacacggatatttatggcaaacaccaaaagcaaattatagataaagcaaaggaagaatttcaggagttgcttttggaatattcagaattgttttatgaactggagctggatgctaagcccagcaaggagaagatgggtgttattcaggatgttctgggagaggaacagcgatttaaagccatttacaaaagctccaagcagagcgttgatgcccttattctgaaacacattcattttgtgtaccacccaacaaaggagacatgccccagctgcccagcttgtgtggacgctaagattgagcacttgattagttctcggtttatccggccgtctgaccggaatcagaaaaattcactctctgaccctaacattgatagaatcaacttggttatattgggcaaagacgccttgcccgagagttggccaatggagattagagctctttgtacaaatgatgacaagtatgtgatagatggtaaaatgtatgagctttccctgaggccaatagaggggaatgtcaggcttcctgtgaactctttccagacgccaacatttcagccccacggctgtctctgcctttacaattcaaaggaatcgctatcctatgtagtggaaagtatagagaagagtagagagtccacgctgggccggcgggataatcatttagtccatctcccccttacattaattttggttaacaagagaggagacaccagtggagagactctgcatagcttaatacagcaaggtcaacaaattgctagcaaacttcagtgtgtctttctcgaccctgcttctgctggcattggttacggacgcaacattaatgaaaagcaaatcagtcaagttttgaagggactcctggactctaagcgtaacttaaacctggtcagttctactgctagcatcaaagatttggctgatgttgatctgcgaattgttatgtgtctgatgtgtggagatccttttagtgcagatgatatactttttcctgtccttcagtcccaaacctgtaaatcttcccattgtggaagcaacaactctgttttacttgaactaccaatcggactgcacaagaagcggattgaactgtctgttctttcataccattcctcctttagcatcagaaagagccggttggttcatgggtacattgttttttattcagccaaacgtaaggcctctttggctatgttacgtgcctttctttgtgaagtgcaggatattatccctattcagcttgtagcactcactgatggcgctgtagatgtcctggacaatgacttaagtagggaacagctaactgagggggaggagattgctcaagaaattgacggaaggttcacaagcatcccctgtagccaaccccagcataaacttgagatctttcacccattttttaaagatgtggtggaaaaaaagaacataatcgaggctactcatatgtacgataatgctgccgaggcctgtagcaccaccgaagaggtgtttaactccccccgggcaggatcaccgctctgcaactcaaacctgcaggattcagaagaagatatcgagccatcttacagcctgtttcgagaagacacatcactgccttctctgtccaaagaccattctaagctctctatggaactggagggaaatgatgggctgtctttcattatgagcaattttgagagtaaactgaacaacaaagtacctccgccagtcaaaccaaagcctcctgtccattttgaaattacaaagggggatctatcttatttagaccaaggccatagggatggacagaggaagtctgtgtcttctagcccctggctgcctcaggatgggtttgatccttctgactatgctgaacccatggatgctgtggtgaagccaaggaatgaagaagaaaacatatactccgtgccccatgacagcacccaaggcaaaatcatcaccattcggaatatcaacaaagcccagtccaacggcagcgggaatggttctgacagtgaaatggacaccagctctctagagcgagggcgcaaggtttccatcgtgagcaagccagtgctgtacaggacgagatgcacccggctgggcggtttgctagttaccggaccagcttcagcgtggggagtgatgatgagctggggcccatccggaagaaagaggaggatcaggcatcccagggttataaaggggacaatgctgtcattccatacgaaacagacgaagacccgcggaggaggaatattcttcgcagcctaaggaggaacactaagaaaccaaagcccaaaccccggccatccatcacaaaggccaacctgggagagtaactattttggggtgcccttaacaactgtcgtgactccagagaagccgatccccatttttattgaaagatgtattgagtacattgaagccacaggactgagcacggaaggcatctaccgggtcagcgggaacaagtctgagatggagagtctgcagagacagtttgatcaagaccacaacctggacctggcagagaaagactttacggtgaataccgtggctggtgccatgaagagctttttctcagaactgcctgaccccctggtccgtataacatgcagatcgacttggtggaagcacacaaaatcaacgaccgggagcagaagttgcatgcccttaaggaggtattaaagaaatttccaaaggaaaaccacgaagtcttcaagtatgtcatctctcacctaaacaaggtcagccacaacaacaaggtgaatctcatgaccagcgagaacctctccatctgcttctggcccaccttgatgagacctgatttcagcactatggacgccctcacagccacgcgcacctaccagacaatcattgaactctttatccagcagtgccccttcttcttctacaatcggcccatcaccgagcccccggcgccaggcccagctcccggaatt

SEQ ID NO: 702 - DNA, 1581 bp, Homo sapiens
  Genbank Accession No. M73720
ataactaaattacattttcttggtcttttgactatgaaatagtttaccctagcaacatgaaaaacaagagacctaagctattagaagaaatgcagttctatgtatcttgtgtgtatagtttttccctgggtggttttcaacgaccagtgactccttagctggtttcctcagctgctagcacttgctctgggtacttgtcctcaacacgtccatctgcaacaatgtgtgcctaggaaataaactcaacttactactcacccaaccaaaatgtaattttttaaacgcagcacacactgggtggattccaaagtcatgattatgctttactatgcactctgtactattcagaccactactctcattcattactgcaattaactgcacacataactattttttattgctaattatacaccactgatttccactttaaaaaaacattagcatttgtctctaattaaatatttactgcttgtgttttacagacccgatatcaggttcttctttagactgggcttatgacctgggcatcaaacacacatttgcctttgagctccgagataaaggcaaatttggttttctccttccagaatcccggataaagccaacgtgcagagagaccatgctagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccctcagtttctcacagattttcaccatgtggcttcatcaatttatgtgctaatacaataaaataaaatgcacttaatgctttaaaattcatctttttatgataaacaatattctctgtatttctctatagcattaataatcaatattaatgccattcattcagtctgttaataagaaataatatcttcaattttcaaaaacataatttgcctatctttttctgatagaagtagacattgtttatatcttcaaaaaagcaaaaggatgtcctagcaggaaataaagtggttcatatagagatgaatctcagtcctttaaataaccgatccagttctcatcagcataatgtacattaaattcaaaatagtttaatttaacctgccataatcagaagaaaccacctgctaaaacatctgtttgccggtacagacacagacaagacagtctggtcagctgtgacccctgccctcctaatggatagaaaggaaacctggaaacatactgtaagttgaggacggaaagtcatgttgaccaaaggcaatcagggtaacttgctgcatttgtaccatttatactcctattatttaagatagtattattggatagcttctccc

SEQ ID NO: 703 - DNA, 1071 bp, Homo sapiens
  Genbank Accession No. M84526
gcagttctggtcctcctaggagcggccgcctgcgcggcgcggccccgtggtcggatgctgggcggcagagaggccgaggcgcacgcgcggccctacatggcgtcggtgcagctgaacggcgcgcacctgtgcgcaggcgtcctggtggcggagcggtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttggagatcagcatgggccacgtagcgcgactccatctctacaaataaataaaaattagctgggcaattggcgggcatggaggtgggtgcttgtagttccagctactcaggaggctgaggtgggaggatgacttgaacgcaggaggctgaggctgcagtgagttgtgattgcaccactgccct

SEQ ID NO: 704 - DNA, 1599 bp, Homo sapiens
  Genbank Accession No. M87789
tctaaagaagcccctgggagcacagctcatcaccatggactggacctggaggttcctctttgtggtggcagcagctacaggtgtccagtcccagatgcaggtggtgcagtctggggctgaagtaaagaagcctgggtcctcggtgacggtctcctgcaaggcatctggaggcaccttcagcaactatgctatcagctgggtgcgacaggcccctggacaagggcttgagtggatgggagggatcatccctctttttggtacaccaacctactcacagaacttccagggcagagtcacgattaccgcggacaaatccaccagcacagcccacatggagctgatcagcctgagatctgaggacacggccgtgtattactgtgcgacagatcgctacaggcaggcaaattttgaccgggcccgggttggctggttcgacccctggggccagggcaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagtgcgacggccggcaagcccccgctccccgggctctcgcggtcgcacgaggatgcttggcacgtaccccgtgtacatacttcccgggcgcccagcatggaaataaagcacccagcgctgccctgggcccctgcg

SEQ ID NO: 705 - DNA, 11298 bp, Homo sapiens
  Genbank Accession No. M89796
  unsure (1)..(11298): n = a or c or g or t
aagcttttcaaaggtgcaattggataacttctgccatgagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttctcaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttgtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagccagaagcatttcctcataaagactttaaattgctaggacgagaatggccaacaggagtgaaggattcataactttatctttacttagatgtaaagaacaattactgatgttcaacatgactacatacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaagatgatatttataattcttaattataaatatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatacctgtaatccagctacttaagaggctgaggcaggaggcttgtttgaacctggaaggcagaggttgcagtgagctgagattgtgccattgcactccagcctgggcaataagtgcgaactctgtctcaaaataataataataataatagaaaataaagttgtcttcatgaaaaatgaggaaagagattgctggggtgagaaacattaagatcaatgggcatatggtgaccttctatgccctagaaactcttttanggtattttctcctggtatctcttttacncatcgttctatctggaaaaataggtggatgagtgagataataacggtatatactttttaaaggtctaattgacatatataaattgcaagtatttcagatgtcaatttgctaaccttgacacacatagacacacatgaaaacatcaccacattaatacaatgtatgtatccatcattccaaaagcttccctgtgtatctttgtaactctttcttcctccctccactccttgtcctctcgttcccaagaaaacattgatctgcttcctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtcgtctgctaaatccttagtgctcagatgacttgttcaggactctccttgaacctgtacctctgttanattgaaacttgtctctactgtctttttatttcaaacacagcttattaggtgtctctcaacccatcaaacncacaatctgagtctttaggagattgctttgaatttgtgctattgacttatatntatatnaaatntgtaaatgtttggtaaaaatatcatcatgtacnttttcataattacgctatntncacatgatatatgtcagactctggaaatatgcatgccacagacacgtgtttcttgcctaaaggggctgatggaagacncacatacnaatagacgattgcagtagaatgagagtggtggtctaancagtacatgtcctgatgttgctcggacagttactacnccaagagtaccccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccgccttattcgtatacncatttaattctgagaagcactctatagaaaataagaataagaaaatattgggctcacaggtgacattaataagtaactttatcgagtaccccaaattttacctatgtttggaagatggggttaaaaggacacattgaaaacaagaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatatatcattagaaacataaattgtaccatttaacatacatgaagtttatgtttaccttgacgttcttctaaaaagtgtcctacaccggcattgtccttgtaggcatattcacatgatcaaataaaataattagttttcaattaaggagaatatttgaggaaagaccgtacgtgttcatgtggttcctgaaggcagtccagtgagaaagtaatatatgcttcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtatgtgtcactttaaaaggactggtcagatggtagggagatgaaaacaggagatgctataagaaaataaacttttggggcgaataccaatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaatatggcctgggttttctgaaacatttcttccagaaaatagtttctccaagttttattactttggtttacaaatctcacatttaaatcacattttataccataagtagcacacatttcataatattcctctgaatgagggttgggataataggactgatatgttagaaatgccttaaagtgtgtggagcatgagagatggatgtacagaaggcttgtgaggaaaccacccaggtatctggccttgttttctgccccagaactagccgcctattcctgtttctgttttattcctttgtttcttgacttttcctttccaacttgctctaaaacctcagttttctttcctttctgattcatgactaccaaatgttttcacttgcctcacccgtccattacacctttgataagaaccaccagaccttgtgctcatgtacttgcccatgtctgatggaagaaacatactctctccatctgtccactttcctgaggcattcaagtctagccaccttttaaaatcactctcctccaggctgggcacggtgtcacgcctgtaatctcagcactttgtgaggctgaggagggcggatcacttgaagtcaggagttcaaaaccagcctggccaaatggcaaaaccaaatcttcttcaattataaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggttttgttaaggggctactggaaaaatttctattctctccacagcctgctggttttacattagatttattcgcctgataagaatattttgtttctgctgcttctgtccaccttaatatgctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaacttttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgacgtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggatgaggcaggagaatcgcttgaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagtctcattttttggctttgattttggggagacaaagggaaatgcagccatagagggcctgatgacatccaatacatgagttctggtaaagataaaatttgatacacggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagcaaattccacacatgagtattgtgcatgagtaaatgaataaaacatttgcaaagacctttagagaaagagaatgggagcatatgtgcgaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtacgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtaaggacaatcaccagccatcttttgtcaataattgatggaatagagttgaaaggaactggagcatgagtcatatttgaccagtcagtcctcactcttatttacttgctatgtaaacttgagaaagcttttttctctttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacacgaatcagaactatttggtggacatattttcaaaggagtagctctccactttgggtaaagaagtgatgcnggtcgtggtggctcacgcctgtaatcccagcactttagggaggccaaggcgggtggatcacgaggtcaggagatcgagaccatcctggctaacacggtgaaaccccgtctctactaaaaaatacaaaaaattagccaggcgtggtggcgggcgcctgtagtcccacgtactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaagaagtgtgtggagtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccggggngtggtggtgggtacacctgtagtcccagctacttggaggctgaggctggagaatcacgtgaac

SEQ ID NO: 706 - DNA, 3386 bp, Homo sapiens
  Genbank Accession No. M91029
cgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggcgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagaggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagt

SEQ ID NO: 707 - DNA, 1746 bp, Homo sapiens
  Genbank Accession No. M92843
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 708 - DNA, 2075 bp, Homo sapiens
  Genbank Accession No. M92934
cccggccgacagccccgagacgacagcccggcgcgtcccggtccccacctccgaccaccgccagcgctccaggccccgcgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccctgcgacccgcacaagggcctcttctgtgacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcttccccagacactggtttgaagaatgttaagacttgacagtggaactacattagtacacagcaccagaatgtatattaaggtgtggctttaggagcagtgggagggtaccggcccggttagtatcatcagatcgactcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtcttggcaggctgatttctaggtaggaaatgtggtagctcacg

SEQ ID NO: 709 - DNA, 3321 bp, Homo sapiens
  Genbank Accession No. M94077
agatcttcagtttgactctcttagggcacctcaagactctgggacctattcctcaagcacagccctgtggtcacctggtatgcgtcctgtgccagaggttttggaaacaatgtctgccatccactctgactgggtgaccccactgatgagcctgccacactgttgcatcagagaaggggccagtcacacaccaggctgcccatctcaagaatgccaaaaccttcatgaatgggccatcctgtgcctgcatcacagggaggtggggccgacagccacgggtcacgtaactgaggccaaacacaagaagctggcctggatcaatgagtcagggagagctctatatataacctcaggagatcagtcgtcctcacattgccagcatcttctctcctcactcacccttcctggtgctttgggtaagtgtggttctactgactctctcattttcccagctggtcttgcccaggcctgactagattagatggaccagggcctctttcccctttgggagctataggacctctgccttcccaaaagcactcacatttagagggcggtcaggaaaggagcaggggatgagctgctgccatgcagatggtgtttctaggtcttctggccagaatgtaaactccacaaagacaagactatctcctgcctctctggcacccgcatagggcaggcatggtgccgggcacagaaggactctgcagaggctgtccaaggcagcctgtgcacaggctgagcagaccttgtgaacctgtcaggaggagaggctgagccactctcaagagagtagggagaatgatccaaaaaagttgcagatgggagggatttcaggtgccacagaaatccaattgctgttttacagagttagaagttctgagagggaaatacaacttcctactagtcaaagtcccttctaccaaacttggacttgagaaaatcatggaagagatggctaatagcttctggtcggggatgttggtccaaaggaccaccagggtccttcccctgtttccaggcagggccacagcagagcctgtcttttctagtgactagcccttggttcatggcctagctcagtgggacagaccaagagtttgaactaagagcttctgcagaggatggagtgcaacagccctcaatagaatgaagtccgacaaacctctctctgttgtgctgggaatgggtaaaatctcctatcctaggtagaggtttgtggtagttttctatttgcactcagagaatcagtgttgagattggaagaggcctgaaagatgaagtgttcaaaccctttcatttaacaggaaatgagaaagaggcgggcgtgtgggtgatctgccctcaaatcacacaacagtggtcagaggcagagctgggagaaagaatgggcactgctaactgggctgtttaaagcataatgaaggctttctgcaggggaatgaggaactcaacttttccaaaagcagcaatcataagaaacccgctgaggctctggcacctgaaggagccctgggaggatggcgatgttgcctatggatgcagctgcctccgtaagtatcctcttgcagctggtccagcgatgctctcttctccccttccaggctctccttccttctcagacaagatgtcttatcagaaaaagcagcccacccctcagcccccagtggactgcgtgaagacctctggcggcggtggcggtggcggcggcacgggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggaggcggcggctcctccggcgggggctctggctgtttctccagcggtgggggcggctccggctgcttctcctccggtggcggcggctcctccgggggcggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgagaatctttaggtctccaagagtatttgtagtgttcaagttcatccattccattccattcttctcctttcctgcattcgctcattcacacttacattcattttacaaatgcacgcactctattggcggaaaggtgagtggatagatgggagtcaccaggagagggaggaatggctggcaaacgacggtcaaacatatgaacattctagtgtacggcttaaaatcatgacgtgatcccaaaacacaaagatcctgaggagagacttcagtaaacacctccctgtggattgagtagctactgtgggtctggttactgaactctgttttttaaagacaggctgccctggaaagacgctgtctctcacagtccaaagccaattctgcaaggtctgaaagctgggtggctgcacattaggagcaccagctcatgctactcagactcacggagaaataaaaagcatatcagatgtttacgggcccctagggagagcaagaccactttagtaggtacc

SEQ ID NO: 710 - DNA, 593 bp, Homo sapiens
  Genbank Accession No. M94547
ggcacgaggagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggcaggccacgggggggcacctcaataaactctgttgcaaaattgg

SEQ ID NO: 711 - DNA, 1080 bp, Homo sapiens
  Genbank Accession No. M94880
cgaaccctcctcctgctactctcgggggccctggccctgacccagacctgggcaggctcccactccatgaggtatttcttcacatccgtgtcccggcccggccgcggggagccccgcttcatcgcagtgggctacgtggacgactcgcagttcgtgcagttcgacagcgacgccgcgagccagaggatggagccgcgggcgccgtggatagagcaggaggagccggagtattgggacgaggagacacggaatgtgaaggcccactcacagactaaccgagcgaacctggggaccctgcgcggctactacaaccagagcgaggacggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccgtcgggcggagcagctgagagcctacctggagggcgagtgcgtggacgggctccgcagatacctggagaacgggaaggagacgctgcagcgcacggacccccccaagacacatatgacccaccaccccatctctgaccatgaggccactctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtaccttctggaaaggagaagagatacacctgccatgtgcagcatgagggtctgcccgagcccctcaccctgagatgggagccatcttcccagcccaccatccccattgtgggcatcattgctggcctggttctccttggagctgtgatcgctggagctgtggtcgctgccgtgatgtggaggaagaagagctcagttagaaaaggagggagctactctcaggctgcaagcagtgacagtgcccagggctctgatgtgtctctcacagcttgtaaagtgtga

SEQ ID NO: 712 - DNA, 4519 bp, Homo sapiens
  Genbank Accession No. M95678
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaa

SEQ ID NO: 713 - DNA, 1109 bp, Homo sapiens
  Genbank Accession No. M96995
gccagtgaattcgggggctcagccctcctccctcccttccccctgcttcaggctgctgagcactgagcagcgctcagaatggaagccatcgccaaatatgacttcaaagctactgcagacgacgagctgagcttcaaaaggggggacatcctcaaggttttgaacgaagaatgtgatcagaactggtacaaggcagagcttaatggaaaagacggcttcattcccaagaactacatagaaatgaaaccacatccgtggttttttggcaaaatccccagagccaaggcagaagaaatgcttagcaaacagcggcacgatggggcctttcttatccgagagagtgagagcgctcctggggacttctccctctctgtcaagtttggaaacgatgtgcagcacttcaaggtgctccgagatggagccgggaagtacttcctctgggtggtgaagttcaattctttgaatgagctggtggattatcacagatctacatctgtctccagaaaccagcagatattcctgcgggacatagaacaggtgccacagcagccgacatacgtccaggccctctttgactttgatccccaggaggatggagagctgggcttccgccggggagattttatccatgtcatggataactcagaccccaactggtggaaaggagcttgccacgggcagaccggcatgtttccccgcaattatgtcacccccgtgaaccggaacgtctaagagtcaagaagcaattatttaaagaaagtgaaaaatgtaaaacacatacaaaagaattaaacccacaagctgcctctgacagcagcctgtgagggagtgcagaacacctggccgggtcaccctgtgaccctctcactttggttggaactttagggggtgggagggggcgttggatttaaaaatgccaaaacttacctataaattaagaagagtttttattacaaattttcactgctgctcctctttcccctcctttgtcttttttttcatccttttttctcttctgtccatcagtgcatgacgtttaaggccacgtatagtcctagctgacgccaataataaaaaacaagaaaccaaaaaaaaaaaacccgaattca

SEQ ID NO: 714 - DNA, 14537 bp, Homo sapiens
  Genbank Accession No. M98447
ctggtaggaatcagcctggtgccaggggccatcacagcggtggctcccaccaaagcccagcctaagcccccagacctcacccctgctccctccctagcatcttctccccatttcccgcccagaggcctggcctcttctctccgccccctacagcagtttggcccctccctcccacataagtcacttaccaggtctgtccctgcggcatccagtctgtgggtcctgtcccatccatcctgacctgttccatctcagccccaggactcagtactgcggttgccaacactgctgccaggtgaggggctcccacgggtactgtggtgccgagtccaggcggcccacactatcagaggccgtgcctggatccagcaaggtggggtgtgggccagctgtgtacctgtcagccccagctaggctgttcccaacaccaagactctgctttccctgtgcacaggctccggcacctgccatgccctacccctcctggcagccccaagtggggtcttccctgacttgggaatgccaaggaccacaggccccggggtcacttgtctgtcttgtgaggaaccttgagttgggggatttctgctaagaaatgagttctagaagctgtcagtgttgtgcacctctagactgcagagctagcaggtggacggaccaggcccagggatgctggagcactctgatgtgtgtgcagctgggtcttgaggctgggacaagtgtccatgcagggaactatgtggatttcctgggatggatcgttgagtgggtttcttcattgggcagtttttcggatgttgtttggtgggggtgaggggaaggcttttctctgcagcatgagaagcttctctgggtgagtctgaatggtcttcgcggaaggtctctggatgtgtctggagaatctctgggccaaggtgggattgtttcggtcatcgggtgggactgaatcagctgtctggatggagggtttctgggtcaactggctgggactacctgggttaaggagccaccctgcctcttcctaacaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgaggtgaggccggtctgtcctcctcagctgagagctaaaaggctttaatgggaccagagactcagcctggcatttctgggggggataggaagctaatgataagggcctgggctcctcatggggcttcactgacacggagctgtgtccttgcagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggtcagtggggcttggattgggacgggtgaaggccctatgtttggtggggagaggctggcattagggtcagagaggtctttaggctcctccctgccccactcctcacctctgccagataaggcaggtgcaagtgtgtgggtgtgcccctggggttgtgtctcagagagggtcttggtgttgcagtttttcccaagcccatcctcctcaagcctcctggggcatcggtctcagagtactcctcttcagggcctgcctcggtgcctccttcggcattgctgctctgtcctttgtgcatctgttctcattccccaggatgtggctggttctctcttctatctctctctctccctcttgccttccatgtcccccatctctgccaattctgtctctctctgtctctgtccctctgtccccatgacccaaggcaggtgcctccctcaccgcgttgcttggtgtagcttgacttctcaggctggtgattatgctgctgcctggggcaggtgactccttttaccctttgattagggcctaaccttgcccacctcatcctttaatttcccaggaacccctaccacctccaccagggatgccctgggctctggaagctgcagccccaggaagcaggcagggttggccttcaggatcaggactgccctttcatacggggcaggtggatctgcccctccagcccaggcactgtgatagtcaggcaggcagaaggtgacaggagccctcgtctctcctccccacctcagagttcagtgtcaggggaacaggtttgggatgttggactgcggcactgccctaacatgtgggcaagcattgggtggagacagagctgctctaagggagactgtcagagaataaggtgatggcccaacgtaggggacatacacagtggctcatacacattgtgggtggggccgggagaagtcccaggctccatcccctctcctcagggaggccttgccagctaattgctgatttcctactctaggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccaggtgagcagctggggtctggagcagagggtagatgggagggaaagacagggaagggcttcctgccctcggatgtggcggggtgcctaggtgcctgaccccaggagaagccagcctcccattgggcagatgagaggaccgaggcctggtgcagaaaggtggccagcccagggtcacacagccagccacacctctcctggcaaaggcccctggctacagccaatctcctccaccatctgtcatgctccccgtgtcctcccacagcagtcctgtcaggctaggggcatccccgcattttcttctgtggacatgagtcctgcagaactggccagaagtaggtgaggcccagggagagaactggagggaaccagttttgtgtgttctggggacacagaggacattgtgtacgtggaccatgaggattggcggcaggagtatgttcttaatgagtctgggagaatttactacgggaccgaagcacagattggtgagcggacctggaactacggccaggtatggtgcggctggccagggtcacatacacccagaggagctggggtgggtgtgggggctggggtattggagcagggtgctggcctagggttcaggctgtcacctctgccctccatccctccttccagtttgaccacggggtgctggatgcctgcttatacatcctggaccggcgggggatgccatatggaggccgtggagacccagtcaatgtctcccgggtcatctctgccatggtgagcaccctcacatctctgagtcctactgtgtgtgtgcctgctgcctcgccacacccccaccctcctcctgccctttctggattcctcaagaacccccagccctgtccctgccctcgtaaaggatacttcaggaaggggtctccctcctcttctctcccttgcctgccccccaccccgcctttcctggctcctgtcccagctcctgtggaatgtagggccaaacccaaaacttggcacacccaggattcacattcctgtgtcagagcccgggtgggaggggggcagatggctgagggaagggctgggtggagctcaggctggtgtctggatcctgaggcatttaggggtaaggggtggttgcaggatcggggcccggctggtccccatggaccacatggcaggtcctgagcccctcctccacctccgccctatctcatcctgtcctgggcaggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacaggtagtggagggactgggacaggagtggcccgggccctacagggagaagggaggaaagccaggcttacccagccctgcccagatgtggctacagtgcagggtgcaggcgggggtgggtaataggctggccttaattatcattaattagtgttaacaacagagagaggcctaagggaaaggagggagaagggacaggcaaggactgagccaggcaggtggcctagcttcccctgaccccaagtgctctgtagcccaaagcttgtggcccccgtggccctgaccctggagtctatgcccagcttggcaatcctagttgcccttctccccctgatactcctgacacgatgcctcacttgcccccaacccatgccttgaaccccaaccttcgctcctccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggtgagctggggtggactgcccatctgtgctgaagaatggtgacctgagctttggaggtggagggtgggcagggctggggaggctggggaaactgaggactcctgaccctggggctcagacccagcccctcctccatgtccatccaggaacttccatgtgtggaacgactgctggatgaagaggccggatctgccctcgggctttgatgggtggcaggtggtggatgccacaccccaagagactagcagtggtaagctgggccccccactccccaccatgcccctgcttatctcccccacctgattaacacagtccagagtgtcagtgctgggccgggccggagagccaagccatgtaaccccgcggcttcttaaacgggtttgtcagctgaaccaccacgtggatgttagtttatttttaccattctatataactctctatttgcctacattttacttatttataatggtttattttatttataatggttaatatacaagggaggttcaaaattcaaaagctggaagagtattcagagaaagaattcatattcactattcttacttgctttttaacttacatatcctggagataattaactgaaggaccattttaaagtcatttttataagtaatacatgcttggaaggaaaaaaaaagtatagaattgaacaacacaaaatgtaaagcttccctattctctctcaggaggtatttgggttttttttcaaaaatatttttaaagtaaatttctaggttctactccaaacctgatacattagactttcccaggatagatgctaacaatgtatatttttgaaagttcttctggtgattctgacgatcagccggattttttgacccactccaaagggtggccagagagatggagtgacctcctctggggcacagagtggtaggtcagtgacagagcaagtccagtccttttaagcacatactcttgctttcaacgagttccttcctgtctgttccattgctcactgtgagttatatatacagcatagaaaaaaatcagggctcagataggttcaaagaagaaaatagcccttatgaccctgccttaatatataattactgttaatataaccaagggtctcttttctgtgtccacatacatgtgtttctgcagaaattagaactaccatacactctgttctcaaacaaacccccaccccttcttaccgtgataccccagccccagccaccaggcctgccctgccagctaccttctgtccagcctctcccttaccccaggtcagagagtcctccctagcctacattcctcccctggcctcttcccagtgccctccctctcactcagatatgtgaacacagccccatgagctgtgcaacccggtgatgcctgtgatgctgaaacagcctgtcccagacgctggcagatctgagctctggcccccaactctgggaagtggtggggtggacatcaggcagggggctcagggccagccagactggggcttgatcccagcctgatcacttctcagatgtatgctcttgggcaagcacctcgaacttttaggctttggtggtttggatgtaatttggggtaatagataccatatatggtgattgggaggattaaatgagaaattctgtatctgaagggaccagcagcatgccgggagtgtagcagctactcaaaaagtctgagctcctttcattctccctgcaccacctgtcttgtgagatcctggcatgaacttcaccttgctgtttccccgtctgtaaaggagtgtgtagtgttatgtcttgtctaagattctttccggttggatggtactcacttaccactctgtcctctcctgccaggcctcttcctgtcagcctatctcttctagacagcctcctgagtatcataagggcagactctatttcccaccagctccccccagtagaaagggcagcaggctgcagagctgagggttgttccgcatctctctggaatggtggtggcggtggtgtcctcgctctcccagccagcaggcagggccactgtggactctgggttggttatgataaaggatggggcgtcctgtcctctgggggtcacagatggtggacatccagtgtcagccagccatgaaagagtatgtcagggacttggttatcaggcaggctggtccgcacatctgtaccctgcccccatcctccagcagagcagcctgggctgaggaaagcagattgagagccaaatggagccgctctctctttgttttccatacctgtgttgcactggctgtcaactgacccccaagtgtttgggtcagggctgatgaccttgttccagaggccaccaggcagtgggaccgggcctgagtgggtgggctggggccctgtgtggaccttacccagggtctgaagagccctctccgccttctcagatctcttgcctctgtcccgcctcactctctaggcatcttctgctgcggcccctgctctgtggagtccatcaagaatggcctggtctacatgaagtacgacacgcctttcatttttgctgaggtgagggctgggctccaggtgccttcttgggcttcagtcatgggttctctggtcccaacttcaccgctgactgaccagctctgcgacccggggcaagtcactcattatacaagtcagtttcctcacctgtaaaaggggataatcaaggctgccttgcttcctatactcgggatcagaagagataacgggtatgaaactgcttcactagtcgtaaagtcagccattgagtgtgagggattactgatattgccaaagtgctctgccaggagcctcccagaccagcttcttccctgcactctggcctcgtctggctcgtcttggaaagtctccccttggctctgccaggaagctcccacccttgggaccaagccctgtcccatagctcctgggatcaggggaaggaggccgggagtcaggccaccctcagaccctctggctcactcattcctgctcacccccaccccccacaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggtaccattcccccaacccagccagctctgggccccacaacaagtgttcctgccaagtgcttggccacccacgtgggaattggaacctcacccttgaccctcaacccccaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctgtaagtgctccttacccagccctgccccctggatggctgggcacctcagggctgtggacatggagaccccaggagcagtggggagtccctgggggaagcctcatgtagggaagcaggcctcagtgacgccatgcctcttctccacagcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacggtgaatgcagtttgctggggcatgaggggtggtcagagagtgaaggccaggggataaggacatcagaggtgggcgctaagccagcagcaggctggcctgatgagcctttgtaggagaaggtcaaggaccggctctggggcctcagtttcctcatctgtagcatgggatcttatgtctctggttctgtgacagcctttattgaggaataggttggagtttcttctctgacttctggggaatcttctctcaggaggataaatgtgggactcggggaggttttgcttctaagcagcttcccctctctggtgcagtgtacggtccccgtgtgtttggccagggtctctgacgtgggggatgggcctctttttctctcagttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgcttccactctggccttccccacaggctgccctggctcccagctttgctccctctctgtctggacaagtatgttctgtcaggacccaaccaagcaggttggggccagctagcaatacctcccggcccagctcagtcccaccagcctttagggagacctcttgggcacctggtgctatgccatgtccttgccctgcctcactatctaattagggagcagaaggcccacataggaatcattagtaactcattgctaatatttgcccagcactgaagaattgaccaggccctttcaggaatattatctcctttggacacaaaaactctaatttaagtacattagaaggccaggtgtggtggctcacacctgtaatcccagcactttggcaggccaaggtgagtggatcacttgagcccaggagttggagaccagcctgggcaacatgatgaaaccctgtttctacaaaaaatttttaaaaaattaaccaggtttggtgctgtgcgcctgttgtcccagctacttgggagtctaaggtgggaggatcacctgagcctggagaggttgaggctgaagtgagccatgtttgtgccactgcactccagcctgggcgacagagtgagaccccgtgtgtctctctctctctctgtcacacacacacacagacacacacacacacacagagacacacacacacaagcgaagttttggaatcctaatgatacgggttcagctctagcacttactggctatatgcccttgggcaagcgacttctctccttcaagcctcagtgttctcacctgtaaagcagggatagcaatagcccctggacctagggttgtttagtgcactgcttggcacaaagttagtgctccattggtagttgttatttttattattgccattattacccccacttacagatggggaagctggcggtcacatctcatatggtctcacagctcgtagggggcaaactctgctcttcccactgtggtgcataccatgcacaggctctcaaactcattgtttgttttgtgccatgagggccaagtagcagttccagaggagagaactccatccctcaggcccttacccagcccgtctgggcctgatcctgggctgggcaagcccctgggtgtagtgagggcacacacatgctgtgttcctgggcctgcggctgtcatctttgatacagacttacacgtgctgccccgtccccgcctaggaaaagcacggagggaaagcagagcaggccagagcctggccttctagatcagccttctgggacaggggcaggcttcatcttcagacagcgagctcctgagaaagaacaatggcttggggtggggaaactgaggggaggaagcagaggaccccctgcccacttgcccacccctccctcacacacagcagctctcctggtggtggccgccaccttcgccattaggccaaagctgagaaggaagctatgttgatctttgccccagcctgggcccctgggaatgctatgatgtgtcacaaagtagggctttcctcatgtcaccataccatggtctctggcagctcagtgaacagagcctgaaccccccgggtagcctgctctgctagtcttgcccagcaggcatctcttacccacacccccaccatggtggggaggttcctcatcctaagggatccgcagagctggacttgcctcagcagccccaccaggcctttgcctcttggccctgcctggaagtaaggaaagggccactgtgctgagtgttgggggacctgtttcctgtctttagctgtagggtttatgtgagtctccctacagtaaaagacagggttggatgatggtttcttaaggcagatcctccctggacagtctgtggctccttagctgctgtgagcccagaccagagcctccagtacaattgggagcctccagggggacatctctgagctgttggttcaggtacctaagattccaagatgggtgtactttgcctctcattcgcacatcagaggctgtggcatggaaccccattatagcataaggtgtgccacccccctgtggtgactggccacttaataaacattccagaactcactcctccagatggctgttgtcaccaccaaaagcagtcaccagagaggctggaagtctgttccaaacccttcctgggaatttccctcagagtctgaatgatattctctagaatgtcctcagagtggtcagtctgccttcttaggggtagatttgactttgcagagaaacctgaagtcatcaagagctaagactaattaataagataagtgaacaagtgggtaactgcccttttccatcagaaccgaggcatgctgtggaaggaaggacaggctgaccgtggcatcactgagcacacgcctgtgtgtatggtttaaatggctctgaagaagagtccaggaggagttttaaacatgtttcaagcccaggcaatacgattgaacaagtacacaattggacaatgctcgtttcgacgtctaagttctggtgtccttgttggggagttggtttcatgacccacactcagttccaggaacatcccagctttagcagatggcttgtactcagcttcagctcacaaaagaggtgtggtaaagtcccccacctcacaatgagaccaggggagggagagatcttgacatttccacctagaaaacagtttctcttgaaaataatccgttactgcaatgtaaaggttactttctgaaatattatagttcaattatggtatagagtaaatagacttctgagggctggtctgagcttgaacaaccttgaatcttgtatctatgaaaagttagcaaaaattaagagtgcaaatttgtaagcagtcaggacatagcctagccattaagttatagacttaatttatagacttcctatcatactacgttctattatatatccctgcctccctccttcagggagctcagaaacaccttcaagataatcagatcccactcctccttttactttcacttccattttatgacccagaaagtgaggaacagagaagttaaatagcttctcataagcctcacagctaacaagtggtagaaaagggagtagagtggtccagggaaacccctcagaaccaggttccaagccaaatgctttgccctgaaaaaaactcatccttggagttagggatgttggctcattctcttagaggacaatagttaatgcacaggttctatgtctggaaagggtccccagcggcaggcttgggttgaatagggcaccagaggtaaggtttaggcaaaggcaggaaggacaaattcccacaggcacgagcaaatgcaatataaatgcagtcatgttcagtgtataaaatgaaacgtgcagattgctggaggagctcagagaagggtgagtttccttttcctagaggcaggaggtgctcaggggagccgtcactgaggaagtggtgtgccaggccttggaggaaaagtaggccttcacaaggacacccagggtggggaggcagagctgggtgctcattccacacaaggcaaagactgcaaagcatgactgtggaggtgagtctggggaagaaggcattcggtagggctgctcagcaggaggaatgatggggggtgatgaggctgtgcaagtagcagggactgggtcagagtgagcctgtgtgtcaagttagagagccaggatcgtgtgccacaagcaccaaaggagcactaaatccttgaaggatttagttcacctctgagtggttagcagaacagaatacaaaagtgggatgggaggcaaggagtcccgttagaggactagtgaaatcatgattcccaggggaggctgggaatcaatttttcagaggcccatgtggaaaggagaaaatgaaaacactggttgtgtgtgtgtgtgtgtgtttgtccacccacctctctgtctctctctctcacacacacacacacacacacacacacacacacacagagacataagggtttatgtccatttaaagatgtctgttgtctgttcttgggaaggattttccttttttttcaaagataacatccttctaatgttttggtgtgtgaaaatgctcttttctctttggaacgacgatcatagcagagagtgattacttttcttcaacctatgctcttgtcaaaactgaaagtatttgaaaatattgtgttgggcccccaaagtctcattttgaagttttcttggttttggaaaccccaggtgagatgaggatgttctgtctggggcaggagcagtggtgatggaggggatggcatgagaggcctctgcggtggcatcagcagtctttgtccaggtggatgtgggagcagggagggaggagtcccagacgatggggagagttccagcacaggcagctggtgggtggctgctgagctggctatgcagaggcgccctggggatcctggtcttgggtgtggaaatttcaggtaagcctggaattgtctgaatgggtccacctcctgcttcttcctcctgactgccctggatcagctcttactccccactccacccccaattactccaggcccatgaccttgtctctgcccacagggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatgaagctgctgctctgtccatctttcagtccatgccacaccaagacggatggagccatggtttgtcccagggctgcacatggccttcctgtatcatccactgataggggctggtgtccctcaccagagagagggaaccacaagggaagttgaggctcagagagacagagtcgatactctttgtataactctcttctacctggaaattttcctgtgggtgagttttggaggattttggctttggtttgaatgaaactgttcccttacctcagggtttttcaagtgtagtctctaga

SEQ ID NO: 715 - DNA, 309 bp, Homo sapiens
  Genbank Accession No. M98539
gggtagactgcagtcctccatcctagctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtctggctcctggctgtctgcgctgtcatcacccgtcctgggcctggcctggccacccggacctccccctctaaaatctcagcctgacgtcaacaaaggaac

SEQ ID NO: 716 - DNA, 2653 bp, Homo sapiens
  Genbank Accession No. M99487
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 717 - DNA, 385 bp, Homo sapiens
  Genbank Accession No. N20967
aaagtagagacggggtttcaccgtgttagccaggatggtctcgatctcctgacctcgtgatccgcccacctcggcctcccaaagtgctgggattacaggcatgagcactgcccccggctgctttacttttttgagagggtggggcagtcaggaaaagcttttgagaactatggactcccaccagcagtaatgtgcactgcacacacacagcatcctgcagacagcctcgagggcacgccggcaccctgaagcgcgtgcagaaccccatggtactgacctactccaaacaactggtctgttctgttcgaccccaaaggagcttgccccgtgtgcgtcaggggatcaagagtggcagaggatgtctgttcttggcaaactccccttg

SEQ ID NO: 718 - DNA, 301 bp, Homo sapiens
  Genbank Accession No. N22006
ttttgaattcataatcatttattgtaaatcactcacagtttacacattaccagtggcaaaataacactgttaaacacctactggatgaagaacttcattgtgactatttccaattgccatcatatctttttctaaaatttaaaatttaacttttaaatcctacatcttttctgaaaatatctatcttcaaagtgctccaatactaacactataagccctttcttttgctctaacatctaacacaaagggcacactgtcccattaattccacatgcactttacaaagcaacttcacacacaa

SEQ ID NO: 719 - DNA, 301 bp, Homo sapiens; identical to SEQ ID NO: 718
  Genbank Accession No. N22006

SEQ ID NO: 720 - DNA, 416 bp, Homo sapiens
  Genbank Accession No. N22115
tttttttccatatttaacatttattttactttgctgagcaagaatcatagacagctactaccacggctgcttcgtttggacaaaaataaccaggaggcatccacgggattagttacacggtatcaacttaccaccacagcagaatcaacagttgactcgctaattaacagaaccgtttgctagaaagcactaatctagttatataaatactgaaataggtcacatgcaaaacactataaacgttttgtgtgatgtacttttagttctccatagttttgtttggtataaaggaaatataatttggctgtgacgtagactgttgatgtaattttcaagttttcctgtatggggaaagttgccctgactgtggcccttttcaaggtggagcctccaacaccacgttgggcagattcaga

SEQ ID NO: 721 - DNA, 246 bp, Homo sapiens
  Genbank Accession No. N22297
  unsure (1)..(246): n = a or c or g or t
aacatgttaaagaaatgtttaattataaaattaagcttatacataatctaaaaattttcaaatgtactgcatttatagcataaaagtacaattagtaaaatgattcactagtaatttaattacatttaatttaaagtaaaattaaaaatgcttttctctatgatgcagaatattactccaaacacctacctcatgcatcactcaatatgaaaagtaaactaacagggnctctccacttaagatttt

SEQ ID NO: 722 - DNA, 450 bp, Homo sapiens
  Genbank Accession No. N22620
  unsure (1)..(450): n = a or c or g or t
tttcaagtcacagattacatatatttacattaattcaaatgtccaaagcacagtacagtagggtctatttaatagttcacataatttaagatttacatatacacaagcacatgaaccaatattagtttgctagaacagggatttaagaagttactcagacattttggtattgacacttacatatttatggcaacaaattatgatgactttaaattttcaatgagatcttttgtacaagaatacagaatgggaagaatgtacaaaatgaaaagacaggcaaacaaatgtactttccttggcactatttctataacaccatatagggttgtgggcctcggtgccgaaattccctggcaagccccggggggttcccacctaagttctnaggagccgggccgccacccgngttggaagctcccagctttttggttcccctttaggtgagggtta

SEQ ID NO: 723 - DNA, 368 bp, Homo sapiens
  Genbank Accession No. N23352
  unsure (1)..(368): n = a or c or g or t
nttgcacttggggtaataggtttattatctctatatacaagtaagcatttattgatgtttgtcaaaaataagagacaagataacaaaaactattttagcatgaaaacgagatagctgcaatagactaatactgagcttaaagactccaaaaagagcacagaacctgaaatgacagttttcaggttgtatagttatccagacaatgaagtcaactatacaaggcaagcaacacatgacaataaaacaccatcaacagtttcccactggaggatggagggaggcttgctggggcctgggnaactangtgggaaaaatatttaaaatctcataaatcctccgtatcctttttttccnatttcagggaactt

SEQ ID NO: 724 - DNA, 375 bp, Homo sapiens
  Genbank Accession No. N23730
  unsure (1)..(375): n = a or c or g or t
tcgcattcaacttaaatgnttaacatngacaatgtcttggaacaataagcaaacaatgcttaaatttttcattcaaattcactttccacatgtcaaaagacctcaaggtagaaaaaaataaaataaaaatataaatatctgagaatccatcttaataaataaattaaaaacncnnnccaacgttttcacnnccccntgttaatgtcagaacattcagaccacctcaacaatgcatgatcagtaacattacaatgaacattgatgttgaagaaaaactacagtacatggatatagctatttatttctatctaccagaaaataaagtcgtatcttttcttagtataatattggtcatttctaatcagaacacactat

SEQ ID NO: 725 - DNA, 469 bp, Homo sapiens
  Genbank Accession No. N24761
  unsure (1)..(469): n = a or c or g or t
anaattcaaacttttatttggcaataagttcagagtcacataacacataaaatcaacatttaaaataaatagcaaattcacatctagaataaataggtctgcctaatttgcattaattgtgcctgatatcatacaggcacaatctgtcattccacgagataactggaaaagtctccaaagtcagagttcaaacctgcaggactgaaaacacacagaagcactgtcgcaggttgggttccccgaaagcagatactgaggtggagaatggcgtgcaggaaggttcataggacagtgctgtgggctgagccggctgggtacaggcttgtcagggagaggcactgggctgtaatgtggccacaatgaggtctcactggaccccacaaggggctctggagctgggatggccccagaggttttcccaagttggggtgaggaggccagacctttgtaccccatatggagccggtaa

SEQ ID NO: 726 - DNA, 454 bp, Homo sapiens
  Genbank Accession No. N24899
gttgttggaaaaacatttattgcaattcagtgtcaaaagttttttacaaaaatatgccaccgtctggtacaaacaactataaaaaatcagttcatcatgcaagaaaagtgtgcaaataatttatacagaaggactcagctcacacaatattaaataaacatctctgcatgtaattggtctaactttatgctttagttacaatgttcaaccccctctaatacttttcatttaaaaaagtacattaaagcttctaagcttaggacacaggctgtaatatacgcccactttagccatggtgattggcacttggtagaataaagattggcaccaaggattcccaagtatagaatacagcttggagccttctgcttaacagacttgtgcttcgttaattaaacaaacacatctatactcaaagacagaaaaagtcatgtttaaactccagaaataatgt

SEQ ID NO: 727 - DNA, 441 bp, Homo sapiens
  Genbank Accession No. N24902
  unsure (1)..(441): n = a or c or g or t
ggtcnacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatg

SEQ ID NO: 728 - DNA, 488 bp, Homo sapiens
  Genbank Accession No. N24990
ctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaagctactctttcggttttattttctttagcatattgagtatagaaatctgaaacttatttaaaatttatactgcttttgttgatggctcattttggctgtgtatcctcacttatgtactgatttctggataaaggcttgacattattataacacgccattttgtgttccagtttaataaaacgggttctgagtcttgtctgga

SEQ ID NO: 729 - DNA, 466 bp, Homo sapiens
  Genbank Accession No. N26713
  unsure (1)..(466): n = a or c or g or t
tgattattccagaatattttattttcccaaagaaggttaaggatagaattttgtagagtttttgtttttttaatgcatccaacacataggagaattttattttaaagccctttttaaaaatgaaaattctagttggtcatcaattctcttcagagcaaacatcatttattctactctataaaaagaaacctaaacaaattaagatgacaagtaagaaaaacttattctctttatctcctttaaaaccaaaattttagttctgctgggctggttttcttcaaattctcattattttaccaatgaggcactttataatacaaatgcttaaagtgttgagggattctgactcccaaaaacatcatttggatataacaagatttgtactactgacgttggatatacacaattaaatcnttcctcctagtggatgatggaaaatnaatggttggangtaanaccggatcca

SEQ ID NO: 730 - DNA, 221 bp, Homo sapiens
  Genbank Accession No. N26801
  unsure (1)..(221): n = a or c or g or t
tttttttttcttgatgcaaatgtttttatttgccacttaaactacagtttccctgtgctatccngatggtgtgggggtgtggaacaggctgctggaaccatggtttacagtagtagcaggtagatgattagtagcatgagtggtgaaatgctgcatctaagtgcctgtcactttgctcccaggggaatatcatgcagcccaggaatagtgttagactggga

SEQ ID NO: 731 - DNA, 445 bp, Homo sapiens
  Genbank Accession No. N26904
  unsure (1)..(445): n = a or c or g or t
aagttttttaaaatttattatttattatttctttttgctcttgtttcgtttctcttccttgagcttctttttggagactttgggtctattggcctttctgtataggtgatacccaatgaggcccaggaggntcggcaccatggccatccctaccagaggcaaaatgcccttcaccagctttanccagtagttggctcggattagtgcaatcagctccacgtcatactgcaccactgcatccgctgggacagatggtggaaatccccgttttccataggccaagtgagaaggaatgattgcccttcgcttctctcccacacacatgtcgagaagactctgctccagacctggaatcacctgcttttggccaagttctataaccagagggtctctggtccagggaggtgtcaataatacgtccatctaccaagcttcccgtgtagtg

SEQ ID NO: 732 - DNA, 438 bp, Homo sapiens
  Genbank Accession No. N29568
ctttatcggtatttgtttgtttctgttccttatcttttccattctctgtcttctgctcttctagatacctctttgtataggctgctcctcctgaagcagcactctcctccttctgagatgagccatatgtggagccagtggatggtggactcttacccacagggctctttttggatggactcagggacccagaaccatggtcgaactgaccttggtgtgtcccagactgatacccggcaccactcggcagagttgagcccatctgggatgtgctggaaagtggaggactaggttttggcacggggctaggacggggtgaccgccgcctcaccaccacagactgggagggggcttttgagagctgggcttcgctcccgaggactcagctcagaaactgctgaggcccgtgatgcagaaccagtgccgtaggtggcatca

SEQ ID NO: 733 - DNA, 497 bp, Homo sapiens
  Genbank Accession No. N30198
tatttttcatgaaatgatttattacttttagaaaacagtataaacttacaaactataaattaagatataagtatatttctgccaaagtaagtcaagaaaaatgcacttcagaatcagcttttattacaggcaatgtattgtaaactcgaacatccagaatctgagttacacttattatttttaacattttactcaataaaaatctgatatactgggtccaagtgatgacacattccaaattaatgtaactttcttgcagcttaaataaacaaatttagatcaccaagtgaaatcaaagccaagtgtatttgcacaactcaagaatgatgtgaatggattagaatctctcatagtgcatacttcgccatttatacacaaactttgagagtcttctgagtgacatggtatttaactttgtttccaagggccaaatactaaaatgtatagaatatcctactctatactcactattaaatgtcatggactagggaaatctg

SEQ ID NO: 734 - DNA, 585 bp, Homo sapiens
  Genbank Accession No. N30856
  unsure (1)..(585): n = a or c or g or t
gattaaaaagagaaaatatactgtaaaatatttatttaataaaaataattttataatctatacagaattgaataaaaagtacaacaaattattttcacttatttacaaaactgcatacagtacaacttgcacattgagttcagcattctataaatatggccacataccaagatgtgaacatattcttgtcttatataagaaaaggctcaggttgtatgccacaaactttgaattaaattccagggaaatattgctttggtaacatgaacaatttgtaccacattccattaaaaaaagatttaataaaatccctcaaacagcacttttctacttgtttcggagtacacaattcccaaattagcacaaacaaaacaaagcaaaaaaagaaaaacagacagaatgtaaaatgnaggttgctacttttatgatatcacttccctttcccttccttagctagtggtcctttcccttcccctaatagtaagggtgggngaatggaaatggcctattcctatccccatccatttgcctccaggatccctgcttaaccnaatgnggtatggtcgncttggccacctgncaccc

SEQ ID NO: 735 - DNA, 544 bp, Homo sapiens
  Genbank Accession No. N32521
ccagacattatggccaagcatgccatacaaaactgtgtttatcgtgaaacaatctgagttaggaaactaggattgttgccaccaccatttatttatctagttcataactaaggatagaacactatagcagtgctagagatgcaaagacgtccctgcccttaaggggttacaatcttactggagaatataacaggcacataagaagctggactacaaggaagcatgagctaacaaatgccagacttcggaaggcagcgtagtttgagaacatgggattcagagtcacaaaacccacatcctagtcccaacccagtatatcagttaacctctctgggttttttcccagctacaacattaaattagtaagactggagaggctgtctgcatgtttccatcatcattcagatcaaaagctgagatgagctttagggaggaggctgcacctgagcgggacactgaaggaaggcaaaggaggtgtttcagacaaggcaaagcagtactgaggtagctgtaagcttggagtttggatgggagcgacagccag

SEQ ID NO: 736 - DNA, 579 bp, Homo sapiens
  Genbank Accession No. N32748
  unsure (1)..(579): n = a or c or g or t
cagcagaagagtgacctgattttattcaccttttattggaaatctgtgggacagaactaggcaatgagggtgctacaataataaaggtgagtgttggcagtggcttgaccagagcagaagtgggaatgaaacagttggattctgtttgttttcaaagaagagctcatagaacttactgatggnttgttatgtaggatgtgaaagaaaaccacagaaatgactccaactaaaacagtaaaatgccattcactaatttcaagatgatgagagaagctgttttgcagagataatgaaagaaattctgtttgaagcctattaaagtttgaagtgcatattaattggactttcaagttgagatgtcaagtaagtagcagggtctctgagtatggaatacnaggctgtgggcnagtgacttancgtctgcaacatccacatataggcagcatcnccatagcaacaaacatccngttccaaataatccgccngattttcntcctccacgtccatcttcctcagagtccatcaggggccnccagnactggcnaatccacncatgngcccgttacctccttctcngca

SEQ ID NO: 737 - DNA, 355 bp, Homo sapiens
  Genbank Accession No. N33927
  unsure (1)..(355): n = a or c or g or t
acaattctccgcagattttattaattataactttttttttcagacgtcctgccatcttctcattcagacttttcttagcaaaggtagtccatggcaagtaatgaattcccagtaactaggtctgtaacagaagtaaattctgtttttatgtttataaactcaaaaagtaacatgaagtgcaaacacctttagttccttcccctcggtaaccttcttttgatgaaccagtgtgcagcaaaccaggatgaagttggatttgggtgggatccacacaggtcattttcaggcaagatgagacttcccaagttccatgnatagattcatattatcagttattttatgcattcatttctcc

SEQ ID NO: 738 - DNA, 442 bp, Homo sapiens
  Genbank Accession No. N34517
ttttttgttctcaaatattttttaataaatagacgaaaccacgaaaccactagactgatggcagcaaactaaggtcagatgagaggggaaactagagaaggagcagcctgagtcagtgacacaacctcctccccgaccctctaggttaaggcacttccggggaggcaggtccttggggtcctgttacacagggtgaatgggagaggaagggattaggatcccttctccccacctttgcatcaggacacccctgcccttctcaccctaccccatggccctgtccctgatttacccactctcatctcacagcactctaaggggaagtttgggtgggaggagttcttgtgggtgggagaggtctgtgcccctgaggaagccgatcctgccaaatcttgatgcgacaccagcagcccactctaccctcttcatcccaaggagccat

SEQ ID NO: 739 - DNA, 455 bp, Homo sapiens
  Genbank Accession No. N34817
  unsure (1)..(455): n = a or c or g or t
aacagggatttatagcagctttattcaaaataactaaaatttggaagcaaccaagatgcccttcagtaagtgaatggataaactatggtacacacaatagaacataattcagcactaaaaagaaatgggctatcttgtcctcaaaagatgaggaaacttaaaagcatattactaagtaaaagaaggcagtctgaaaaggctacttactatataactgcaactatgtaacatgcgaaatgatggagatggtttgcagggttaaggggatgatatgtaataaacaggaagagcagggatgacttttagaacaaagtgttctgtgaggtactataaggctgggatacatgtcattatacatttactccaaacccataagcatgtaaaaccnccaagagttaacccctaatggtaaacctatgggcccttgggaccacctatggatggcnccaatggta

SEQ ID NO: 740 - DNA, 412 bp, Homo sapiens
  Genbank Accession No. N36001
  unsure (1)..(412): n = a or c or g or t
attagtgaattagtttatttaaaaccatcagtttttccaatgtgaatggactggttcatatcacaccatatttagagatacaaggtgattataactaacgtgtctacaagacatactgggtcaaacaatgtgatcaatccaaagggtatctttttaaaaagaatttaagtactcagctgcaaagataagttcactaatgagattttcttttttttttttttaaaaaaaaaaggtttttaatgagtcaaatttattacaaaaacttagtgtgtaatcaaagccaaatacattcctcaggcatgccagcggaacgcaaaataatgttaatagaatgttattaaaaaataaaactttttctgaatgatatatataanacctcatggcacattatcctcatttggacaacnggaaa

SEQ ID NO: 741 - DNA, 425 bp, Homo sapiens
  Genbank Accession No. N38882
accatgccaaaagatttattaatccttctacataggcaatcaatgcatgcatattcttttctttacaaagacaaaagccatttaatcctccttataatttagtttaattctgtttcaaatgtttgaccttgatggcctgcagtgctctatctcttttatgtattttacatattgttataactgacaattaatataaagtccctttcacttagggatacgatctccttgtttcggttttgtagccagtcccccaaattttgcatgaggacaaattcacgattcttatgagtgtgtctttgaatcccttacgtcaaggtttggtgccatgaaggatgaagctgctgagccctgaagtcgtggggctaagggtacacggacaattaagcaacttaagtgactaagcccgtgtctgattcccctgcagg

SEQ ID NO: 742 - DNA, 430 bp, Homo sapiens
  Genbank Accession No. N39415
cagagaataacatttattttatttggaaagttttcctaaatatgagactatctgctatttctcagactaagtgaaaaatttaataaaatagctgccttgataggaggaaaacaaagttcttactttataaggaataacgtatgaatcataaaagaagaatgagcgatcatgggaaacatttagcttttcaaagtttttggaacatgtaccttaaatgcttttgggatccagtaaaggccaggaaaggcaaagagttgaaagtttcttggatttatcctcgtacttacatcattagtaataggaataatgcatctcaaatttggggcatttatataaaaacatgatttttaaatggtagtctagtataaactaggattttgtaatgctgtttaaatattttcatattactttgtttcgaacgtagacattc

SEQ ID NO: 743 - DNA, 443 bp, Homo sapiens
  Genbank Accession No. N40141
gctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgacttgaaaattttgaaaattctctccaataaagtt

SEQ ID NO: 744 - DNA, 513 bp, Homo sapiens
  Genbank Accession No. N47686
  unsure (1)..(513): n = a or c or g or t
gggtttatggggtttaatttttaatactgttaacatcatcgagccagctaaacaccaagaatatcaataaatactaatagtttgttttcacttcctccttctgttggagcactttgactttatatacattccagtcttagtgccaaggccccattgggtttcaaattccataccagagcacatcacctggatgtgactctcatatgctcaaggatattcctggagttgaaaggaaatacaaaatgagcataagaacagattacagacgcgtcagtatgaaagttgatactcgtgaaaaacagcagtttgctgagaccctggaagttagctggagcagtcaggcagaaatgactcgtgaccatggctgcaaatggggcttgttctcacaaagggctttccaccattcttttcttgggcttgcaggtagaagatgcggttttcttcaggataagtaactttactgaggggcatcttgtagatgttggaattttttgtggtcatgatgaggaacnt

SEQ ID NO: 745 - DNA, 442 bp, Homo sapiens
  Genbank Accession No. N48056
atataatattcaactttatttcaaatataccaattttaaaatttatcaatatacccattacgattctttctgagtgacataccacacaaattcaatacggattctctaaagaatcctcttaggctacttcactcaaagtctctgcagctgcctgcactgtgaaggctgcaacataaatctgtctcttcacttctccccaggccttggaagggtccactttgctttcaatatcaaacagagcatcataaattcctgggaatgactcccctgcatacttgttgtggctgcttggagcatagatgacatgcctataaaaaggcctgtctggtaaccctaatggatcaataaatgctctttccagaaacatgagttgatcattcatcattcttaatactattgggttgcttttggtcaaagtcctggagtctctcactgaacttgg

SEQ ID NO: 746 - DNA, 475 bp, Homo sapiens
  Genbank Accession No. N49899
ttccaacaacatttggtttataaaggaatacaaacaggcacaaaacatggttcagaagatttattaagtaaacttgctaaaatatggacagatacacttagcagtcaaacagttgaatattaattgctacctcattaaagtttttgtatctgtattaccaggtccaaacataaaaaccacctctgttcaaaaaataaatgttcagagagctgtatgttctttgttcttgtatgtacattttaaaaaaacacctctttccagtcttgctaaccaagaatattagtcatataaaagaacttagaatttttttccccaagtacaagctatcttttggctccaaaacagttctgaaggttttatttatattttatcttatcccgagggaccaacagcagggcatacctttggccaggccttcttggcagaaagacacagagccgtaaagggaaaaaataaaattgccataaaggtatag

SEQ ID NO: 747 - DNA, 474 bp, Homo sapiens
  Genbank Accession No. N51529
  unsure (1)..(474): n = a or c or g or t
gcaaaaaataaatataaaatttattaaaacacccacaatattttaaagataccaggagtaatacagttcacaaacccagttgtttgtgtaaattataataaaatacaaatcaaaaaggatacatacttgcaatttctaggcaccctaaattaaatttactgaaacactgagggagaagggagggtaaggaggggtagctcaggaggcaaaccaataaagtggaaggaaaaaatattaacaaaaaggtaaaaattatacaaaataaaattatcagcgtaaatttactgtactaagaatatctacagtttaatacacatcctattgcccttgagacatttgcaaaaatctaccattcatccatcaaccccagattaaacttcattttcaagtagccccagttttaccaagtcnagacnggaatatttccagtatgggttgttaagttcacctccantgggaggcccagttacccaa

SEQ ID NO: 748 - DNA, 469 bp, Homo sapiens
  Genbank Accession No. N51579
atcaaatgcttttgattatttattagacagccgcactgtaccaaatccacttggctgttggtggtttgagaaacttgttacatgctttcattgaagtaataagatcctgctcttcataatcgcagactctcaacagctggtgagtgggagaacctcatgtaaacaacctcctctgagttcattcttcagggctcatgagaccagtcaccttttcttcagctgaaaaaacacatcaagaaaatgaatgcttctgtcctaggggaacatgacacaatgagaagtaatcaataactagaaatagtgtgggatcgtctttaaagaaaacattatgaaatgtaagaaggctacacacacacacacacacacacagattaacaaattttaaaaagatatctggggagatccccttatcaactgtggtattcatggcacaagtttatttaaaatctggtggcctacatttcccaat

SEQ ID NO: 749 - DNA, 507 bp, Homo sapiens
  Genbank Accession No. N52254
  unsure (1)..(507): n = a or c or g or t
tttctattaatctttatttatatgatggttctctggaaagcacttcattttaaaacctgtttctgagataagtagcataaggcgcatttgaagaaatactattgttgtatcacagagaacttccatgccttgaaatcatttttttcagagtattattaataagatggtctagctatgcagagcaaaaaagaaaaaaaatcttcaaaagccaagactgtcaggcacatgaaggtatgcataaactgtcttcacatttaattttgtatgattcgggagatacctccatgtacatctaaccaggtcaggcagcataagtcctcagtaaccctggggtgtgccggcttcaagccaaagtattctgttgagtttggtttgtggagagacatttgaaatgttgcttcatagcttccattttctggagaagtggaagaaatgaagcgtnaaaaggcctaggaaatcctcgtcttctccaggctcttcttctccttctgcagnttcctcctcctc

SEQ ID NO: 750 - DNA, 166 bp, Homo sapiens
  Genbank Accession No. N53359
catctaaaagtggttttttaatatatatattttttccaaaggaagaaatttcttgcttttactcagggaaaaaaaaaaaattaaggtacatttgagtagaatgatttcatctaaaagagttctttcaggagacatctgtgattcactgcattgtttttattttctt

SEQ ID NO: 751 - DNA, 380 bp, Homo sapiens
  Genbank Accession No. N53447
gtatagagtaaaatttattatagggttgtagaattcatacaacctaaactccttacagcattcagcacctacacaattttgtgcattccaaatacagatagtagtgagaaagaatcactgcattagttaaaaatgactgtctcatgaaaattcgttcacatataagtcaggttaattacagagcacctaacagaactgcaaagatgtaatttctaaattcaagaaagttgtacaaaatgaaaaacaaaagaaaccaacaatgttgagatctgatatattttacacaaaaagttcaaaaacaatttaaaatatttcaaattttaaaattgctccaccataagatgaataaagagcttacttaaaggaaaagaaaaaaggaa

SEQ ID NO: 752 - DNA, 260 bp, Homo sapiens
  Genbank Accession No. N54053
acaggaaaaataaggcatttattacagattgaaactgatcagaagaaaaatcacagaattcacaaaatcattctttgttggaacttttcttccttccattgcattttgctgttaagagaaaaggagtgtgagggtcagaccaccgtggcatgcgttcacattccagctttggaggccagggacccaggactcctgggaattattcaaaaccagatccgatgataccagacactagagcagctatgaaagaagcagctcct

SEQ ID NO: 753 - DNA, 441 bp, Homo sapiens
  Genbank Accession No. N54845
  unsure (1)..(441): n = a or c or g or t
tgctagcttagatattctactataaaccatttcattgagtacctattatgtaaccaatattttaaaatatacactgaatctgaggcaacccaaaatgaacaatggaaagaaaactagtaaatctgaaatgtacttcacattctacttaatctaatttaaaatataaattcattgtgcaacccataagaaagatggtccaacctgtgggtatttttaaaaattctaacaggagaaatcatttaaaattttgctttttcacaatggcaaaaaggaaagaatttgaacataatatttaatttttaaaaaaattcagcctgactccgaccctgaagatttcagaaagaacatccgtcactattaaaatggatggacagggcccaaatggggggattggtttaanccagnttttcccaangttaaacccaggaattangcccccng

SEQ ID NO: 754 - DNA, 427 bp, Homo sapiens
  Genbank Accession No. N55085
aagttccaaaatagcaaacataattttattccacttttgttaaagaatgtacataaatatagaaaacaccattaatggtggttagattaaagggagtaaggacttgcaatacatactttcttctttatacttttatttcctaaacttttcggcaataagcatgagttactcttctaaacaaacaaataaaccaacaaaatacatgaacctagtgtatgaatagcaatattccaattagaaaataataaattttatgaattacctaatcaggactgtttgttatggatggaaaatttccaccaaaactgcagaaccagaaaggcaacactactatttaaaacactaaaaggtggtgatggagaaacaaaatctgctctatgcattataccttggatgattgacaagagagaatataaatttattattc

SEQ ID NO: 755 - DNA, 400 bp, Homo sapiens
  Genbank Accession No. N55502
ctgtgaataaaacttttaataatgtacagcagaaattggacaggctcattcttatattaaaacaaaagatttcctatattacaatttatttacatttgcatactgaagaggtaaagtgtctaagtggctattttacagtcctttctaataaaatgtacaaaaacaaacagaagtaccgagaatgccgttcgggggcctttatggcgacgtaagaacgggcttggacttggtctgtgaatccagaatccagaggtgcaggtagcactactggatcagggttagcctcggggggccaaaaacacggcttcagtttctccccaactctcacttagtgttaagagtggcagaggtgggtgtgggagcttcccaaagacctgctccatcttccccagaggtggaa

SEQ ID NO: 756 - DNA, 430 bp, Homo sapiens
  Genbank Accession No. N57577
ttccctcaggtggttaaaggccaccaaacaaatactgggcaacaggggtttgttgggagagttagaaataaaaaattaaccaaattttgtccctgtgttaattcaatgccagcaaggaggcaagtactgaagaagaaaagggacaattttcatactaaaaaagaattcctctaatcatgtcaccatctcatataatgaatccagggaatcccagaaatagaaaattagtttcaggggacccctgaggcactttaaagccttttaaaaaattacagtaataataaattagatattgctcttcagaggctaacagagcagcagaagcatcaagatcaggtccaaagagttatgcccacatttacaggcttcctggagctgctcagccctcttttaaagcttagttgaatcctttaaaataccctttaaaaag

SEQ ID NO: 757 - DNA, 369 bp, Homo sapiens
  Genbank Accession No. N58172
cctgaccgtactcctcaaaatccagattgtttgtgcatacatttaaaaaaaaaatcaatggaaatttccacctttgttcgaacacataaagtatgccatgagcaatataacatcacaaacgtactgtgacaaaccattaataaagaaggattactaagccaggtgtggtggtgcatgcctgtagcccagctatgcaggaggctgaggcaggaggatcacttgagcccgggagtttgagtccaccctgggtaacacaccaaggactccatctctaaaaaattaaaattaaaaggattactgaaagatctcatttctaaaaaaagaaaaaagaaaaagatcactggaagtccagacatgatatttttaatt

SEQ ID NO: 758 - DNA, 445 bp, Homo sapiens
  Genbank Accession No. N59532
ggcaagtaagaaggaagtttaatttttttttcaggattcagtggagtccattaatgcataccaggggcaaagatcagcccagggtaaggcaagtctgggaggaagcccaccctgccctacagcagccctggaactcagaataggtggtgagtctgccatggtttgctactgggcagcacactagaccaacttgggaatgtggaagagtgagtctatgttccctcagccatccccaagtttacacacaggcatagcagccctactgtgagtcagcaatcattcctgacttgcagtaaggacaatttgcatttacggaaagcaaactggagggggtagcctaagtccgcactgcccatgttattaccctttgcaatgtgaaaaaccatggtgaggtaggttgggcaggttttatcctctccacaaaggtgagcctttgctccacagc

SEQ ID NO: 759 - DNA, 473 bp, Homo sapiens
  Genbank Accession No. N59831
  unsure (1)..(473): n = a or c or g or t
acctataaatatattttattcatacttttaaatattttacaattcaaataaaaaccttatatgtagacaatctgggctaaatttccatgtatgttttgaaaaataatgttagcatgaatagattcatatttaaatatgattttaaatactcttaatagaggagacataagaaatatttacataaaagctaagtagcatgatacagctcatggttattttcctcataggaaaacaattacttgattttttttttttgcataggattaagactgagtatcttttctacattcttttaactttctaaggggcacttctcaaaacacagaccaggtagcaaatctccactggcnctaaggntctcaccaccacttttctcacaccnaagcaataggtaggnatccaggncccaccttctgagggnccggaaggaatgggttccggaaaataatggnttttaaaanattaccattaag

SEQ ID NO: 760 - DNA, 452 bp, Homo sapiens
  Genbank Accession No. N59862
tgcctggccacatttgctttattataaagatattacaaaggactcagttgaagagatgcataggacaaggtatgggggaaagggtgcaaagctttaatgccttgcctgggtgtgccatcctccaggaacctccatacgttcacatatccaaactcagtcctcttggttttgtagggaggcttcaagatgacagcattcctttccgcagagtataggacagaaccctctctgaaatgggggtcttaggactcacagaaaggtaggggaagatcaagagtcccgtcttagtgaaggtaaaagggcagaagtgaagtgagtttcctgtggcctaacacacacaacatgactataacaagggctatagaagttatgaacgaggaactgtgggcaaagatccgtaaaaccagagtgactaaggcagtttacctaaaattatgcgtgaaaccattctc

SEQ ID NO: 761 - DNA, 441 bp, Homo sapiens
  Genbank Accession No. N59866
gttttttttttttttttaatacaaaatttattttatttctatgtactaacaatgaacaatgggaggtatttacaattacagtcaaaaccataaaacacttagaattttacaaacttcaagacctacacactgaaaactataaaacatttccgagaagtcaaagactaaataaatggaagatgatactatgttcatcaattagagtacttaatatgttattaattctcactaaattgatttatagattccatacaatcctgctcaaaatcccagcaggctttattctggggaaatattgacaacctaattccaaatgttatagggaaatgcaaaggacctagaacagccaaaacaacttgataaaaggacaaaattgaaatccttaaatttgactcccatatttccaacaaatctacagtaattaagacaatggatataggg

SEQ ID NO: 762 - DNA, 419 bp, Homo sapiens
  Genbank Accession No. N63047
  unsure (1)..(419): n = a or c or g or t
nttattttaaataaatattttaattctattgttgacatttacaagtagaaagcatacagtatgttacaaatatcaaaatgagaaaaatatgaatgttacataagtaacaaatataaaaaaagtattttcttaccttccctgaaagtaagaaaactattcagcataggaaaatatcagtatcaaaaacacagcttaggtgtaaaaaaagtttttacacagtatttaaaaaaaatgatctacaaaatgacaaagtaagtgttgaaatctgatttcatataaattataaaaactgggtacttagagtaaatgttatctggttggaaaataagtccaatcataagctttccttaggtcaattctttaaaatattaaaagcataccgaaaaattttccaataaataaccttnaagaggggttcc

SEQ ID NO: 763 - DNA, 189 bp, Homo sapiens
  Genbank Accession No. N63536
  unsure (1)..(189): n = a or c or g or t
nagcaagcaaaaaactacctttatatatgatgttattcaaatacatggataagataacacattttatgatgtaaaaagtaatatttaaaaattaaaaggcaagtctttctggtattcagaagtctgaagcaaccactgtccagctctttaaaaagagcacattccattctggtggcacacaaatgtaca

SEQ ID NO: 764 - DNA, 523 bp, Homo sapiens
  Genbank Accession No. N64683
  unsure (1)..(523): n = a or c or g or t
acaacttttttaatatatatttttataaacaggtcacgtgataaaatagcacaagaaacacttaccaaatataaggttatatcttccgcatatacaggagaatgaggtcgttatgtacaataagaaaatgattttaggggttggttggttttgttttcctctctccccttaatttttcctcctacagtcgttggaaatatcacagcttcagttgcattaatactttgggcaaatggacagctgcccctccccactaggggtctgtggggaggaggggctggagaaactggctcctgaccactcagccctggagcttcctggggctggcactccagggacaggaaaatctttgggctgttgatctgtttctgattcaacagcatctctctctctctttnccctctctctcncagtctcattctctctctcactctctggctctctgggaaacgggtactctcttccaaccagatagggagtgtcccaagattgggtgtggggcgcggtatctcctggggncttt

SEQ ID NO: 765 - DNA, 483 bp, Homo sapiens
  Genbank Accession No. N66001
gagcaattattgaaagtagtgatataattaagagttatgtgtaggtgaatggggagattcatttgcctttgactataagaagaagattattacaacatttataaggttcattacaagtcctagaaaattataaagtgagaagaattctttgtgagtagctcccaatctctccctatctgcccaagtagtagcataatatgtacatggaagtactactttttaaacaaaattattccttctctctttccatctccaccttcaaaattaaattgttcattcctgtctttggagaaagaatctgataaattaatttacactagaggttttgatgaccaattctgatatacatattattcctaccaggctttatttacatcacaaaagtttttgttcagagcttaggatacataaacataaataaattatgaaatttttatttaaacattccaggtaaagagtgtttttagcagaaagagcctcccc

SEQ ID NO: 766 - DNA, 412 bp, Homo sapiens
  Genbank Accession No. N66053
cagcattattaacaaatttattgaacaactagaacttgacaagcacatgccaggtagaggggatacagtggagagcaataataatgatgataatgaggagtagtttttccctagcaggcagcagttgaaaggaatattggtttaacatccaccaatgagcaggggtggatagacccctctcctggagacagagtccataacgggattaaaaatatccctgtaagccggtcacccggtggctcaagcctgtaatcccagcactttgggagaccgaggtgggtggatcatgaggtcaagagatcgagaccatcctggccaacatagtgaaccctcatctgtactaaaagtacaaaaatttgttgggtgtggtggcttgcacctatatttcccagtactcgggaggctgaggcaa

SEQ ID NO: 767 - DNA, 401 bp, Homo sapiens
  Genbank Accession No. N66802
  unsure (1)..(401): n = a or c or g or t
ttttttttcaggccaaactaaagctttatgctataaaaacaagaaataaaataaggagatttataggccggctgattgtcagcaaacacaatatatttactgtattagcatttgctcacagtgcaaatggtacaacattacaccatttcaatatttcggtttttaaaaatgctgttttcattaactatattatattggcattacaatatgacaaaggagcaaatgaaatgttggtgaagaatttcaccttttcacaatatcaagcatatttttttaaccttagtataaggtactataaatccaagaaataaaaacatccacaaaatatattacatctnggtttgtcttttttctaagtactcaactttatacaaaagtctttcaaaaaatatcatttcccc

SEQ ID NO: 768 - DNA, 451 bp, Homo sapiens
  Genbank Accession No. N67041
aacatttcatggaaaactttttattggttttctggatagaaacaggaatttatttgccaggaagaatgatcccatcatacttcagctagaaccagtgatgaggatgattcagtcttaaaaaagaaggaaatccagtcataagctacagcatgtatgaatgttaagtgaaatacgccagtcacaaaagacaaatactgtgtaggtatccaaagtaatcaaactcatagaaacagaaagtagaatacttgctgccaggggttgcaaggaccaggaaatggagagctgttattcaatgggtatagtttcagtcaagtaaaataaaagaagttgtacaacaatgtatatatggttaacaatactgtattgtacagttaaaaattaagataaacttggatacttatttttaatggacaatttttaaaaataggtgtgggtaacaatttccaatggg

SEQ ID NO: 769 - DNA, 489 bp, Homo sapiens
  Genbank Accession No. N67108
ttcgtgtgtaaaataaactttattcgtcagaggtttctaaacgctcatccttcaaggaaaacggacatatgctgaagagctgataaacagtctacagcagtgtttttctaacttaatcttgattacaagtccttgccattttcctccagctgctgttgactccagttatatataggttgggggaaaggggattatctatggatgtaggcatcactgtctcttgggcagttatcacatttgcaggctgaagggatgtgatttttataatcaaactatccatttggaatacaaatctggagtggctgtaaaatttgcttctcggagatggagctttcaaatttgggactttcaattgttctgttgttttagttgttctcgtcaactggggaactgtttgtgactaagctttgttaaaagtagagaagagcttttcatagttccaacatcagttgttacctggaaacaaacaaaaacacacacacatatact

SEQ ID NO: 770 - DNA, 341 bp, Homo sapiens
  Genbank Accession No. N67324
acagttcactgcctttcaaagtgtttattcagaattatactagaagtaatttcatgaaaataatattgtgcaaccttttcattctatttcaatgaaaagcaggcatgaacattactcaagcttgaaattttactgaaaagtaaacatttcaattaagcttaaggaaaaaagaaatttcctgagatttccagtgtatacagaagtgtctttccattaataataattaaaagttaaaaaatatgctgataacttgccacaattgacagaatgcagattaataggataaatggcaaacaaatctataaaaatgcatgcagagaatcagagtgatcaccccacca

SEQ ID NO: 771 - DNA, 231 bp, Homo sapiens
  Genbank Accession No. N67575
tctatttagatcggattttattttgcaatatttattatatattcaattcaaatgtactcactattgtgctaggcaattgaaagtaaaaagtataaagctgcattttgcgctctcagtgaggtttaagtcagggaaatgaggcatgcacacaaaataacgagaaagtagtataatagctgtgatcattagttatcaaaataagtgaatgagctaataatcattgttagaata

SEQ ID NO: 772 - DNA, 334 bp, Homo sapiens
  Genbank Accession No. N67815
  unsure (1)..(334): n = a or c or g or t
tttttttttttggtaaagacttttaagagaaagaagtattttaaaaagtagcagtgctctgaggctcagggtgtaggatcgggggcacagctggtcccgggaggccccttgtgcacaggtggtggcccagggcnangtgctcgctcttgggggacgcgcggccgggggacngccatcgtntccggcccggggctcccggcgggctccggcggcagggacaatggcgaggccgctcaccacttnaggaanaccatcccggccaggacggtntagcccagcaccaggaagaggaccttnagcanacggtcactcttctcctccanctccttggcca

SEQ ID NO: 773 - DNA, 478 bp, Homo sapiens
  Genbank Accession No. N67876
  unsure (1)..(478): n = a or c or g or t
agtcaagtactttcttaaagaaacaatagcaccacattggcatagctgggccaaacaataaatgggaaagcaaaatgtgctacatcttttattctaagccttctcccaagtgcataaaatagtaacagaaaccctggagccacagagcatgagatcggtttcatctacacaaacattgacgttccaaggagaggaaggattctcaagggtggacaggctttttgtttgtttgtttgttttttaataaaattttcaaggaagtgatttcttttcagtattccattggatccttagggtgaatgtgtgtgtgtgtgtgtgtgtgtgtgtgtgtgtgtgtgtgtctgtgtatgtagggtgggtgttaagagattttcatatccctaagaaagagtggattcngatggagagctgcattaactttttcaggggaactgcctcatcttaaaaagtncaaatctcgtgccgaattcctgcagcc

SEQ ID NO: 774 - DNA, 386 bp, Homo sapiens
  Genbank Accession No. N67899
  unsure (1)..(386): n = a or c or g or t
ttatccacaacggcatctgtcactgtatcatttataaaaacaaggaaaaacaacaacaaaaagcaaaccaacccccaccaaaataaatgacaacaaagaaaaacaaccaaagggcactgggggatacatgatgaaaccttcatacaaaagagatactaggtagctttggatgtaggaaaatacataataacatggtaagacaaacatgaaatagcggaatcagatttcaaagtagtatgtttgtagttttacatacataaaaggtgcacacaaagtgaaaattcgtccaaaacccagcaatttcccttgggagttngggtgggtaaggagtaaggatgtgattttgcatgctgtttgtaattccccattttctccaatgggaattg

SEQ ID NO: 775 - DNA, 415 bp, Homo sapiens
  Genbank Accession No. N68350
accggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttgggagcccctttcctccagctggtggctccttctcagggcctggcctcattcaggccactttgtagagaaatgccctgacctcgcaggaaggatttcccc

SEQ ID NO: 776 - DNA, 285 bp, Homo sapiens
  Genbank Accession No. N69207
tttctttattatacttttattgtttgtttaattcatttttgtctgttacaaataaatttcaaactagagagtcacagatgttaataaactcgcccaatgcatcacctgcctccgaattccatagtttccactgccttgcgctacttgcattctgattagagaatggtaatgtgtgcctctctgaatcaagttcaagaataaatgccctatcctggctaacacggtgaaaccccgtctctactaaaaatacaaaaaattagccgggcgacgatggcgggcgcctgc

SEQ ID NO: 777 - DNA, 293 bp, Homo sapiens
  Genbank Accession No. N69222
  unsure (1)..(284): n = a or c or g or t
ttttatgagcaagcgtggtttatttcataaatgcaagggtagcttaacattgaaaacttaatctaatttataattatgtaaatgaaagaataaaaataatatgatcacgttaatatttacagaaactgcatttaataaaattcaacattcattcatgatttaaacaataaaagaaaactcttaacaaataagaatagaaganaccttcaacagtctgactttaaaaagagaaagccccagaaagcctatgnaaacattttacttaatggtaagataaagtttttttctaaaaa

SEQ ID NO: 778 - DNA, 320 bp, Homo sapiens
  Genbank Accession No. N72253
  unsure (1)..(320): n = a or c or g or t
cctttttcttaaggaatccattcatgttggaagcccagattccctaacatatgcactagtggttggctctgggaagtaacagtcaccagagtctggaagttcttcgcttgaactttgagtagccactggtactattggaagccagatggccanggtattggnaaatgggcaaggggaaatcccaagctgggctcaagagccgtgggttagggaagaagaaggtcaagtggactggtaaaaattctacttcaactgcccttattcatagatacaactttcctaacagtctcactctccaccagtcccatatccacaaccca

SEQ ID NO: 779 - DNA, 465 bp, Homo sapiens
  Genbank Accession No. N74291
  unsure (1)..(465): n = a or c or g or t
agagaataaaacttggatttattcagaccgtatgcttcccatttggggtgcagagtgggggacagtcatggggacagagaaaggcagtgcatttggcttctagggacatgctgattgctgactctttgggtgacctttgggccaccagatgaccagctgaatgatggagatggtgatgaaggggctggcggccaggtccttctggagacctcacagtgattccaaacagagaccaacgctgtgtccagttggctctgttcctctccagggattaaggagcagatggctgggaacactcagactaattaaagaaataaaaactctgggtagagggacactctggggggctccaattcaggcagtggtgtgcaaattcacacatgtcgatgcgtgggccaggcccgtgtgaaaaacatgtgtgtgtcngtatatattacatcctccacaagcanctgggagccccca

SEQ ID NO: 780 - DNA, 212 bp, Homo sapiens
  Genbank Accession No. N75870
tcagcactgatggaaaataccagtgttgggtttttttttagttgccaacagttgtatgtttgctgattatttatgacctgaactgattatttatgacctgaaataatatatttcttcttctaagaagacattttgttacataaggatgacttttttatacaatggaataaattatggcatttctattgaaaaaaaaaaaaaaaaaaaaaaaa

SEQ ID NO: 781 - DNA, 229 bp, Homo sapiens
  Genbank Accession No. N75960
ttaaattaatagatcaaaagctgctcgcattacagagacaaccaatagtatgaaaaaaccagcatgctatcaccaaaatccaaactaagaaaaactctacaaggtaaacaacacaacttcttcaacaaatatattgtaagagggcagagagatgctgatgaaccaataggtgagtgaaccccaaacctgcagcttcagatcacctgggaatttggtagagatgcaattt

SEQ ID NO: 782 - DNA, 440 bp, Homo sapiens
  Genbank Accession No. N78630
  unsure (1)..(440): n = a or c or g or t
gtttattaaaccagatttattctccacaagctgaagatacctgaggttacatgaggactggcattaaataatttataaatgtatttttgactgacagacttttatcataaggattcatgtgtttacaaaagcaaaatccaacctctccagagctagaaagtgggaaggtgcccgggctgcaacacagccttgggggaggatgaggccacataattctctctgcccacactctcagaatgccccaagaagttagtagctacacaaagccaagccttgggggaaaacctggtccgtggtgtggactctccaaaatgcagacccaaccggangccgggcccgcctttccatctggaggcactgcagggcttctgaaagcggcccatcccaggagcctggcaaacacccccagagaccctcaggatgcgcagccccggggcttt

SEQ ID NO: 783 - DNA, 144 bp, Homo sapiens
  Genbank Accession No. N79070
catttcttataaatttattacataataatattataataattattatcaataataataatataagaaacatagatctctgtggggcgtatcacaacgtcagggtcaggaggcctcaggactggagcagggggtgaaaccccggga

SEQ ID NO: 784 - DNA, 446 bp, Homo sapiens
  Genbank Accession No. N79778
atgttagaaaattttaatatatgattttggtagggccaatacatagtaaagacatagctttatttcaattgaaccgaataaaatgatgtatttcagtaaattaaggcaaaggagatagatgctatgaccagtggtgcaaaatttttcaaaaatttatacattagatttacctttacaaggttatagtcaagaataattaatttgtattttaagcaaactctactgcttttcaaaaaatgtcttaatcttgagtgaggaatagtgaaggtaatcttaatatactgtttaactttaaaaaataattttagaattatagaaaagtttcaaaaagagtatagaatttatgcacacccttctgccagctttccttaatgttaacaatgtacataaccataatatgattttccaaaaccaggaaattaacattacagtagtgttttaatttt

SEQ ID NO: 785 - DNA, 409 bp, Homo sapiens
  Genbank Accession No. N80129
  unsure (1)..(409): n = a or c or g or t
agtctagatgaatttattgccattcacatatttcatagaaaaaaagatgtagcaaacgggtcagggttgtacaaaaaaaaaaaaaaatccaggtttatataggttgctctatttacatctgagagcacagctgtcctggcatcaggcacagcagctgcacttgtctgacgtccctttgcagatgcagccctgggcacacttggcacagcccacaggnangcanggagcagcagctcttcttgcaggaggtgcatttgcactctttgcatttgcaggagccggcacaggcacaggagccaacaggcgangcaggagcagttggggtccatttcgaggcaaggagaagcaggagttcccgattcaagaggaaaacacgcagcgggacagattctcgtgccgaattcttggc

SEQ ID NO: 786 - DNA, 406 bp, Homo sapiens
  Genbank Accession No. N80152
acctctgtcaatgattcttttgagaaaagcacccataatttgctacttgaggattttattccctggattctctggatgctcattgcatgaaaagtggaaaagtttagatctatggaaacagaactgttgcctatatcggaaaatcagtgccttgtggaatacaggtaagaacagtgttgctcttgaaaaagtggacagtgggtggtctgaatgtgtcctggtccctggagtgggtttttagattgatgtggactcttcttagacttgtaagtaaaaaagttgtttcttcccctaaaagggaactcgtgcgccttagacctgggaatttgctgggaaactgaaacattctgtagactttacttgtttccaactgtatcgcagcaagaagtctatgtgccccaggatc

SEQ ID NO: 787 - DNA, 219 bp, Homo sapiens
  Genbank Accession No. N80693
cacggtctgtacagtttatacacagagatagggacccggcctgggcccgaacccctacaaatatagatcctctctacaaaatagagataatttagcccccccatagcagctgttggggggggaaggggagggcacaggaggaagggggagactccagctcctgccacccctcacgggtaacagagggcaggggcagggccggcggggacatgaaggcac

SEQ ID NO: 788 - DNA, 204 bp, Homo sapiens
  Genbank Accession No. N89827
aatgctctaagttatttttatttgctagaagactgatttttggtaaggagcagcatctaataccttgcagaagtacttaagaataggagacaaattccactgataattagcatttcaagtgtgataatcagttgaagtattttttccaccacagtaaaacatacaagtgaagtgcaagagaaaaggtcatatggattatatttt

SEQ ID NO: 789 - DNA, 508 bp, Homo sapiens
  Genbank Accession No. N91461
  unsure (1)..(508): n = a or c or g or t
ctttacattgtctaatagacttgtttattattttaagctggtaaaaagagacttatgattcatgttgaagaaagagttatttgtgcttgatacattgaagacactgttcaaaagcagtttgtccttataaaaggatgacccctgtagtatttcttaggcaaggagggacaaattcaaccaacgaaaagcacatctcgccccgagttccccatgatttctccacatatagcaaaaaaatacacatcagtaatttatttgaacatgcacatcagtgagtaggcancagttctncggcggctactcaagacaacaanngggagaatatcagcattacctaaataaaaaagagaggtgaatcacaccattttaattgtcttaaaaacacggataagaagagcaattaaaatatagtcctaaacagtactagctaatgtagattacntaagtataccatatgattccactaatagtgctctgacaagcataaccnccagttctagttaaccag

SEQ ID NO: 790 - DNA, 154 bp, Homo sapiens
  Genbank Accession No. N91887
  unsure (1)..(154): n = a or c or g or t
atatttattattttattgctacattggaagtgaaaataaactgtaagaagctgccaaaggatgcaacttcatgaagattatgaaactattgaggcacccattgtagaaagttaaaattggcttatcctgcatgaggtggaagcnaaggcctccc

SEQ ID NO: 791 - DNA, 169 bp, Homo sapiens
  Genbank Accession No. N91971
gttttgaacacagatcactttattggcatggctttgttttaagaaaaggaaaagtgacaaagccaagagacagactctgctaacagatgcctgggggtggctggacatttttgcctcatgctgtgcaaagagggggatcctggcccacacatcctgctgattccttggg

SEQ ID NO: 792 - DNA, 139 bp, Homo sapiens
  Genbank Accession No. N91973
ttttttttttttttttttttatggggcagcgggggtctttattcgtcagattttccttcttggcctactccccaggtgtggccagggatagtccatacagtgtggctactgcaaggtcaggatggccagcagacccagt

SEQ ID NO: 793 - DNA, 395 bp, Homo sapiens
  Genbank Accession No. N92239
  unsure (1)..(395): n = a or c or g or t
tcagaaaactaaagcagcacctttattttatacatacaaacagtataaaatgtttattaggtaagagctgtgttttgtttacaatatattatattgcttcaagccaatgcaaaaagttcatacattatattccctatttcattgtgtttagaatatattatattgtttaaatgccantaccacagtgtaatttttttttttttaatactgaatctctggaataatggtaaggtcaaaatatattgtattgagagtttaaaaattaagagcaatttttaaaaatgtaacaaacatctaaatatctgacaataaaatctgaaatgctgtaacttcaacattaactgcaccatccaaattcttgtgacttacgcattttgccccatttaacctttctg

SEQ ID NO: 794 - DNA, 510 bp, Homo sapiens
  Genbank Accession No. N92502
  unsure (1)..(510): n = a or c or g or t
ttttttatacaaacaagtttcttttattgtttccacacattcataataactatagaacagaaagattgttttaatttgctgtcctacttcggtgacctgatgaatacactggtaacagtccccagtttgagtaagatcagttgaagcccttactgtataagtccaaaatttaagaaaaatgaatctcacgatgagcttcctcaggcttcggccgtgcgtggaccagtcagcttccgggtgtgactggagcagggcttgtcgtcttcttcagggtcactctgaaagggttgtctgggcttggtcttgcctcccaggtttcacgcgctgcaggttttacatggctgtggtggatccaggctgggattccttctacttcacagcggtgggagggctcagaacgacagctggggtctttccacagtggacacaaagaggtacgttccagttcttgatcaaatngatcactggggagaaaaggtgaactggggagaataantaacaggccattta

SEQ ID NO: 795 - DNA, 253 bp, Homo sapiens
  Genbank Accession No. N93495
ttttttttttttttgaaagttagggtcctttattgggggatgtcagcagagaacgtgggacatgaaaacaagtcttaggagtttgagaaggggctcccaggacaggctcctctgctttaaggagcctgtcctggagaaattaagcagggccccagtatgtgcagaagttgtcagggggtgcccaggggtatggtgaaggagaggtagtccccaagggcaccccagcggcccggtagatctggaagatggtgat

SEQ ID NO: 796 - DNA, 270 bp, Homo sapiens
  Genbank Accession No. N93798
  unsure (1)..(270): n = a or c or g or t
cacggctcctgttttattgccttcgggtgtccggagcacctgactgccccggggtctaataatttaaggtgccgagaacaggtcaggacaaggggtcgcaaaanaggggctgggggcagntggttacaaaatatacccccaccccacaacaaacaggctagaggagaccagcctggctgtgtcggganggggcgggcagagggcgcccgaccagccttcagagagacagagccacggccagcgccccagagggagtggcggagacaggac

SEQ ID NO: 797 - DNA, 399 bp, Homo sapiens
  Genbank Accession No. N94303
  unsure (1)..(399): n = a or c or g or t
ttttttagcaagacaaggtgtttttattgaggtctcaggaattgcaatttgggagacagattcagctagaagccacttgtgttctgaagagagagggtagaggaggggtttttaaaaaaagctgagggtgattagacaagttgacaagttgttttgaaagaggcaactggcttagtacaaaaatccatagtttattggttggtgctgttgaggagttgtagtgctggtgaaataaaattttccaggatgcagtggtcatcgcaatttggcccaattcaaaggttcaaggtaagctcctgtattgtttttttttttggagcttttaattttttttcaagttgcaggtcatgtagggagtccnttttaagaatggcttcctccctccaatttagagttcct

SEQ ID NO: 798 - DNA, 508 bp, Homo sapiens
  Genbank Accession No. N94424
  unsure (1)..(508): n = a or c or g or t
ttttttttttttattatttagaaatgtaaacatttatttaaaagtaggtagcaagttaaaaatgaatacttgcctgaaatcataaaacataatcaagttctttttaaaacagttaatttttttcctataatttactttcatcgaaagtatattatctttgtttaacatgctagatagaagcaatttagcaacataaaatatattagctatagtatgttcaaaagaatgagaaatataaattcagagatgagaccatcattttttgcagttaaaaaaaaaaatgttgattctggtgcaacatacactgattatccaggttttacattttagggctgaaaccctgaggaacctgctggtgactgtttagcactngagcagagttcagtgtggcatgcgcttcccagagttaaaagcnaaagcagactggagaaacnaaaaacccacatccttggcatttcngaggttttcacctggtaatcntagggtttccccaatttattagaatgtt

SEQ ID NO: 799 - DNA, 462 bp, Homo sapiens
  Genbank Accession No. N95495
  unsure (1)..(462): n = a or c or g or t
tttttgccaaacattagagtttgttttattgcatgacgtttgcataagaaaaaaagttattgaaaactgtaaggcatcatgcaatcattgaataagctaattattaactgtacacttaagataggtggacatataatctaaaatttaaaaactagttccagaaaagtacataaaaaatttaacatgatgagcttttaaatatggtttatagtttcatgttgttaaaaagtgcttcaaatgtactgctggaaagttgctctttacaaatggcgctggggtgatgtcagattataaactgtaaaaaccaagtacttttatggaattagaaagctaacattgtgatccccaacttcttgaaccagttttcaatccccattcaaattaagttgattaatattaataactaaaaacactggtttatacccccaaaggcttggatccagtagnctgtggccaccaatc

SEQ ID NO: 800 - DNA, 197 bp, Homo sapiens
  Genbank Accession No. N98485
tttttttttttttttgttatatacattttattgaaaaaaaattttacaacaaaatattttggcaaactgtaaaagtatacataagtgcaaatatatcctccttttaaaatacaagcaaagtgtgagtatacacggtcataaaaatatctttaaaatatggtggtagaaaacaaccttgtaaaaacgttgtattgtcc

SEQ ID NO: 801 - DNA, 340 bp, Homo sapiens
  Genbank Accession No. R00144
  unsure (1)..(340): n = a or c or g or t
tctaaaatataattgtttatcccaatgtcactccacccaggctgcagtgatggcnaaatcactgtaacctcgaacacctggcttcaagcaagcctcccctaagcttcccacactgttgggattgcaggcatgagccactattgtctgagcagtggctcttcctgcaggctggcttaccctctgcatcccacccatcctgcaggtgaggctgaccatgcccctagggtccaagagtcaagggtaatgaacacacccatcacctntcaaaagtgacggctctgtcctcatcaatatgagggantttcctcanttcctggcataatcagctcaggggacacaa

SEQ ID NO: 802 - DNA, 264 bp, Homo sapiens
  Genbank Accession No. R00440
  unsure (1)..(264): n = a or c or g or t
tttnantgancacaagtaatatgtttatttttaaaagtaacttactatctatcttgtctttttcgtatcagaaaaggtgctgttaggaaaagaaaacgaaagtacaccaccaagttaaagaaagggaagcttggggtacagattcagctgcctcacgaagactgagctggacgggcgtggagaaggtgcttgtctgtcaaggacgtccccgtaaggagcggtggctgcagcagctgctcgctgggctgtggccgggggcaggct

SEQ ID NO: 803 - DNA, 417 bp, Homo sapiens
  Genbank Accession No. R01257
  unsure (1)..(417): n = a or c or g or t
aactattcttgttttatattttattatactggaacagctcgtgtcctctgtctcttgcctcggtgcctgggtggcttgcgcccacnatctcccccctttttattaactagaatcgccatcgccatcattgcttgttgttgacttcggacttggtttcggactccttagaggcatctgcagactaaaaggagacaacataagcataccaatattaataatgccagtaacaacaatgatcctctgacgggtttgagccatttgaagggattaaaatcagggtaattgtttagttatgccttcaaaaatgtgtgagccagggaactgtgggataaatggggcttgtgaagcctccaaagatttgctctttaaggttgtggaaatatcccaagggttaaggttatcatcccnggggttttt

SEQ ID NO: 804 - DNA, 258 bp, Homo sapiens
  Genbank Accession No. R02003
  unsure (1)..(258): n = a or c or g or t
tganttntcatagggctcggcgtgggaacagagcgcaggagtctggggtgctccaccggcggggagggggcgcgcagtccctcctggggggatcgggggtgctaggcaggggtggtggcgcaagaagggtctcgggagccggggggtctggaggtggaggagtctcagcatcttgtttcctgtgctccttcccagcaggtgcaggcccttctgcctggggtcccctctggaaggccctcggtttccccggcgccaagg

SEQ ID NO: 805 - DNA, 408 bp, Homo sapiens
  Genbank Accession No. R08720
  unsure (1)..(408): n = a or c or g or t
gaaacgtgagaatgaaagtggatgcccgcgaatcccggaagtcagactgtttttttcagttccctggaggctttttgatactgattcgcgtacacctgttgtttgaaagctctcagcggngacaatgctgacccagagacacgtccttgatatgttttccagtctggtcttgaactgggaaatgatcctctcgcctcgtccctgcaaagcatgagccagctgggagtacagtgggcgcgatctcgggttcacttgcaacctccacctccttgagtttcaaggcgatttttcccaccttcaggccccctgagtagggttgggggtttacagggcgnccaccantaatttttcgggttaanttttttgtatttttttaggtaggaagacgggttttcccntgttttgggc

SEQ ID NO: 806 - DNA, 294 bp, Homo sapiens
  Genbank Accession No. R08850
  unsure (1)..(294): n = a or c or g or t
ttccnaaancaggcagttaatgtgctgacatagtaacaaggtttgaaggaggaacatctcatgcacgtgcgtggaaacccaattgtcatgtgtatgaactacaaaaggatggggaaaagaacacatttcctcacaacaggantacatgagattagaaagaaaaccggantgaggtagatgcatgantgcacagacaaggntatgtgacaggaagctgggtgacattttgcatctgacatagcagtacacctagagagcccaaggaantccacccccaagttaccagaggcaaga

SEQ ID NO: 807 - DNA, 413 bp, Homo sapiens
  Genbank Accession No. R09379
  unsure (1)..(413): n = a or c or g or t
ttggnttgagtttggcctttcctactgcagccaggtgagagcttaagatgtcagtccccaatatcttcacagagtgcctttatgaccagtttggagaattacgatggtaaggggaagaggcagatatgaagaggaatggttaggggaattgtcattcataactctgtgctatattacttgaggggctaagaaaaatgtatggtcagtgaaacacagtagtgtacccttaaatgccttataaaagaccatccatccagtctgcgcttttgactgtgtgcaagtatcagtaataatgcttttggggggctcagatgaacagcgaacacccaatcagccaggggctctgggaagggaaagctcccaaaaatgaggaagtcccttccaacacccatttttcccattactgttctcac

SEQ ID NO: 808 - DNA, 319 bp, Homo sapiens
  Genbank Accession No. R10896
ttaagccatccaagtaaaaaaaaaaattttaatttaacaatgaaaaaggaacttcaaagggtttatgccaaaaaacaaaccagtcctctgcagcctaactcatttgtttttgggctgcgaccattgtagagggcgatcaggcagtagatggtccctcccacagtcagcgccatggtggtccggtaaagcatttggtcaggcaggcctcgtttcaggtagacgggcacaccatcagctttctggaaaaacttttgtagctctggaactttgtttttcccagcataatcataccctgtgggaatcggaggtcagtttagtt

SEQ ID NO: 809 - DNA, 318 bp, Homo sapiens
  Genbank Accession No. R11526
  unsure (1)..(318): n = a or c or g or t
tttantagcgcgaccatttctttattaaattatacaaaanggnnggggaggggggcagctgtggggctcggcaanacccnggccccaccccggcctggcgctgtctgagaagaggggatctgagggagatccagggatcaggcaggatagggatggggcaggacatgaggctgggggatgcagaggttaggtgggagaggctaccngagaaggaatgaggctggtaggggagggagaaagagagcaaagagagagaggagcaattgggggccagctggagagctcagatggagcaggtcaggaggtggaacaatggca

SEQ ID NO: 810 - DNA, 362 bp, Homo sapiens
  Genbank Accession No. R15108
  unsure (1)..(362): n = a or c or g or t
tttttttttttttttttttttttaacggtagaaccaangtttattaatgacagcctttattacaatcactctcaagtgtaaaaaataaagggtgattaattaatatttaaaactcactcggacttgctgtttggcctttcagtggatgtgccaaagggaagggatcttgcctgattctgaatcaattggccagatggagttcactggagaatgaggcaatcaacaaaaaagacaaatgatgccaactggagagagctcgtgtcttctccatgttggaaggacattacaaaatggcaactntgggtgggggcagagatgaagtaagacaaccttacagtcggagtaagatgtgaatacccttt

SEQ ID NO: 811 - DNA, 416 bp, Homo sapiens
  Genbank Accession No. R16983
  unsure (1)..(416): n = a or c or g or t
ttgcagagacaagtgaacatttatttttgtacctttcttcctatgtgtatttcaagtctttttcaaaacaaggcctgaggaatctccagattcaattatgtccctgggctttgtcgacagctgcaggagtcttagggagccttgtacaaatgctagagttactcatttaccaacattaaacccgagaatagaagatgcaacaaagcaggtttccttcctccatgggaaagtgctgatttcagacaagggcagcagccaatgtaggaaaatgctgggaatttttccttgggaactgggactgtggatgagagggtgctttgcccatggaaccataaggctactgtcttttcttttggncccttccctttcccaggtttttggaaggnataaaggccgggaaataaatctttctctgg

SEQ ID NO: 812 - DNA, 378 bp, Homo sapiens
  Genbank Accession No. R17000
  unsure (1)..(378): n = a or c or g or t
ttggggtcggagtggttttattgggcagcaggggctcanggccggtggggcgtcaccgatacaagtagtcagcctggatnttggcggcgatctcggcctcccacttgtccccgttnttgagcaacttctccttgttgtacagcagctcctcatgggtctccgtggagaactcaaagttggggccctcgacgatggcatccacgggacaggcctcctggggagaagccgcagtagatgcacttgggtcatgtcgatgtcatagcgggtggtccnggcggctgccatcagctctttggctcagccttcgatgggtgatggcctggggcngggcaaatggccttcgcagaattttccaggcaattcaacgtttccttcccc

SEQ ID NO: 813 - DNA, 351 bp, Homo sapiens
  Genbank Accession No. R25116
ccctgcatgccttccacatttttccttttccctttattcatttctttgaccagtggatttggtgtaaatcaggatgttcacactctgagtgagtgacactttgattctaatagggaaggaaatataggaattcttttttttttaattaaaaaattgggcatgtttagtggggaagtagggtaagaatagctgtcaagagtaggaaagagaccaagcagagaaaatcagaaagggccaagggatacaggttgttggggggagggtaaataagtgtgtgagaggtctattcaatttctgtgaggagggaagacgtgattacccttgaattccccgggggcctttacagggggc

SEQ ID NO: 814 - DNA, 234 bp, Homo sapiens
  Genbank Accession No. R25410
gtggacaaatcttttattttctgaagacaagtgatttgaagtccagactgaatggcatttaagaattaggaatcctgcgtgccatcctggagtgaattaaactaaattagagtccagaatatgcagcttctttaagaaaaaattctcctctgaaatattttctttcccactgcattaagtagtgttcctcatgagacatctggaaaacattgattgttaaaatgtgggtctggg

SEQ ID NO: 815 - DNA, 419 bp, Homo sapiens
  Genbank Accession No. R28370
  unsure (1)..(419): n = a or c or g or t
anatggatattagttctttattgagaatcagaaatattttaaatttactaaattcagaggtagtcatggcctctccccaataaactttacagtcttagacaatttgtgcattttaataaattcttagttatagtattaaagaaagtggctgggcgcgggggctcacgcctggtaatcccaggcactttgggaggtccagggcagaggcagggcagatcatgaggtcaggagatcgagaccatcctgggctaacacggtgaaaccccgtctctactacaaacacaaaaaaattaggccgggcgtgggagacagggcaccggtaggtcccgggtacttcggggagggctgaggacagggaggaattgctttgaacccggggaggccaaggttncagttnaggcccgagattcacgggnact

SEQ ID NO: 816 - DNA, 431 bp, Homo sapiens
  Genbank Accession No. R31679
  unsure (1)..(431): n = a or c or g or t
acttccaagatnaacatttttctgtttattcttagaatgtgaattttttttttcaactcagggccaagtacaaacttttgatttttgaaattttttcaactcagggccaagtacaatcttttgatttaaaaattttttttcatgaacaaaccatcagtagttattaaggagcccaagaaataggagatgtgaaagcaggatttctttgtgtttcctttgaatgttgttattttgagtattatcattatcagggtaggagggaaggaaagggtagggctggggaaggtagggtccttatggatatcttgactatgggatccccaggatttacatttcacctggtcacagnggcacacataatttaggataaacatgttcaaggaatggacataaacagaggggtaaacacaggggggctttacatttggggg

SEQ ID NO: 817 - DNA, 443 bp, Homo sapiens
  Genbank Accession No. R33301
  unsure (1)..(443): n = a or c or g or t
gcaacattctttctttaatttccctttgcaaatggaagcccctgagctggtgcccacccccacccctaccccataccctggggacccccgatgcaaggcccccacctcaacctggtgggaaaagaggagcaccccctccctatgatggtccattaaaaaattcctagtcatttaagaaatgaggctgggaatgggagaaaggaactgggaagacaaggcccaggtcaggccagtctgaagatgttggggttgtgagacccttgaggaagggtttgcaagcacatccctaagntcggggccagcatggcttgaaagggagggagaggttgacacacagacagatagttttgatttccttcaaggtcctgcctgcctgggttgttacttttaggntgctngacatttnaccaccaccaccaccaccaccaccaccaccaccacca

SEQ ID NO: 818 - DNA, 247 bp, Homo sapiens
  Genbank Accession No. R33627
  unsure (1)..(247): n = a or c or g or t
aaaaaaaacttttgaatcatttattctttggttgtctacanagacacttaagtactgtatcgctgtcatgcagcggcctgtggaggccctgggggtggctgggcctgtgtcctgagccctcagccagatccagggggtgcggtgtctggtcatgtccactccaagagcagtagcaccatgtagaaggctgtgagcagggtcccctcggctgagtggcagatgtaggctcactgctntgcagccccaa

SEQ ID NO: 819 - DNA, 282 bp, Homo sapiens
  Genbank Accession No. R36881
  unsure (1)..(282): n = a or c or g or t
ttttttttttngtgattatacgttttattagactcngggaggggtaatggcaaggncttcatcangtgttccttcaaattaaaaaaaaaaaatacaaaagctacgtagaaaacgtcagatcagacgactaaactttcccgactcagggccaagttcttcttgagcctgcgctctcgggacgcctgcgagtcggtctccgagtacgggggcggcgcgggcgggtagtaggcctcttcctcctcctccttgtggggtctcctcctctcctccgaccccttcttc

SEQ ID NO: 820 - DNA, 428 bp, Homo sapiens
  Genbank Accession No. R36969
  unsure (1)..(428): n = a or c or g or t
ttttttttttttcaagttgctttttccctttttattaaaaatagactcaagcactttantgtatcatacaaaagtttcattcgctggtggcagccacgggaaagactggccccgtagcactgattttccacctcccctccagggacttgggtcccaggagcagtgactgggcctcagagaaagcccataaagactgcttactctggaagcagccgactaggggctnttccgcgagcagctntccccaccccacccaatggcaaaagttagatactcgaaagtgcctcttcagtgccaagataaactaacaagtgggagtgaaatgggaaaaccctttgattattttactattttcccaggggcctgggggnttttnagtttttccctgcaattcaaagtccttttttcccttacaataggggggtagg

SEQ ID NO: 821 - DNA, 507 bp, Homo sapiens
  Genbank Accession No. R37588
  unsure (1)..(507): n = a or c or g or t
tttttttttagaattcaggtagtgttttggtttattatcttagtgttgtcacaagtgatagaaacccccangaagtnggaangaaagagctccntgcntggacctacattttgccattcccctcttgccctgggntcagaaccttgaagcctttgcttggcccttgcatgttaggatatggccaagaatcagaaactgatgcgtttttccagcactacctgtgtgctgcactcatggaaggtgggaagctatacacaggtatccaacttggttataagacaccagttcccacagggctggatttctcagctgtctgggtaaaccagtggcacttcactgccccaggggtggctggctccctttctgaatttctgtctcaatgtgatataattgccaccattcaggatggctacccacattttggtatgaacaccatgacttctttaaggcaacgggggctttcctnctcagaacagtgcccctgnaatttttcctcctgtgggcttt

SEQ ID NO: 822 - DNA, 239 bp, Homo sapiens
  Genbank Accession No. R37774
  unsure (1)..(239): n = a or c or g or t
tttttttttatgtatttccaaaatcacaaaatgcacaacattcatngtttttaatattgcaacatggaatattatatacagattaaaaccacgacagcaaaaacactcacacggtaccagtttcatatcaaaacaaaacacacaagtgctttttcaatattaaaacgactgtgataaaaacatattaatattttgaaccatgtttacaatagngcaaaattcatattttactaaataac

SEQ ID NO: 823 - DNA, 237 bp, Homo sapiens
  Genbank Accession No. R38678
  unsure (1)..(237): n = a or c or g or t
ttttttttttttttttttttttttttccngttggaaattttttatttaccactgcaaggtttttgctccaaagtgtcacaccagacatatgactacaatgtctcatgcatctttttgtgctttagttcatgactgcaaaacacacacttagcatttgacaacaggaaacacagagggcagaaacaaatcacaaggactagttggtttaggttacagccacattttccccggggctcc

SEQ ID NO: 824 - DNA, 401 bp, Homo sapiens
  Genbank Accession No. R38709
  unsure (1)..(401): n = a or c or g or t
tttttttttttttttttgatttctcaacatcaaagtttaattattacaaaatagttcaagcaacatgatatgantttcaaaaactgtatgttgcttngcttcctngttttgctccaacactaatcatgctgaggtttttgaagcacagctatgactagggcaggcactcttgatttcagtcacaaaaacccttcttggatgaacaatacttgttcttttcagaagaaaagcaattttaccttttctatttctattatgaaaaacagagctaaacaatttttgtatttttagtagagacagggncccaccacgctggccacgntgggtctcganctcctttcaagntgttctgcctgccccggcctnccaaagtgccggggnctacaggatntgaggncacc

SEQ ID NO: 825 - DNA, 375 bp, Homo sapiens
  Genbank Accession No. R39394
cctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatgggctgaggtgggatggggggcaggtgcatggatactcttcagaggctatttgtggaaattttaaaggacaggaagtgtctcagtgacaagttgggatggacactactccccaactttttaaattggggaggaaaaccctcagggtcgagggaggcccgggggt

SEQ ID NO: 826 - DNA, 340 bp, Homo sapiens
  Genbank Accession No. R39467
  unsure (1)..(340): n = a or c or g or t
gagccacctcggggtgactgagcggaaggccaggcagggcttccctcctcttcctcctccccttcctcgggaggctccccagaccctggcatgggatgggctgggatcttctctgtgaatccacccctggctacccccaccctgggctaccccaacggcatcccaaggccaggtgggcccttagctgagggaaggtacgagctccctgctggagcctggggacccatgggcacaggccagggcagcccggagctngngtgggggcnttagtngggggttgntgcttgacccccagcacaataaaaatgaaacgttgaaaaaaaaaaaaaaaaaaaaattt

SEQ ID NO: 827 - DNA, 379 bp, Homo sapiens
  Genbank Accession No. R40030
  unsure (1)..(379): n = a or c or g or t
ttttttttttttttcatttttactggctttcatttggacttgaatatcaacaagtatttccagaataagtatctttatgccagaatatctttatacatgtgtttgtgggtagtagaatggggtataaattttacaaacaaaaatattttttaagaatagtggaacaacttactatacaaaaacaaaattcagaggantttgtgggcaacagcaacctcaagcagcacacatatttcacagagtgaatgttcatggaatattatttctgtatcttacatgttataaacatataaatacaataatttgtatttctatttggggggtcattgttcattgtggacttaacaggtctaaccaagggttttaaacncatattggg

SEQ ID NO: 828 - DNA, 197 bp, Homo sapiens
  Genbank Accession No. R40431
tttttttttttttttttgtcttgtgtgtatttttatttcagggaaagaaatgagggatatgataagaaaaagtctattaaaattgtaaggcttactccagacaccattgcttaaatcactcccctcgcacacagagagaaaacccctgggcaagtgcacaaaaacactactcataaaagcacgggtgaccagtgaac

SEQ ID NO: 829 - DNA, 486 bp, Homo sapiens
  Genbank Accession No. R41798
  unsure (1)..(486): n = a or c or g or t
tttttttttttttttttttgcatttattgtggtaaaatatacataacataaaaccttttaaccatttatttttaaacattttaagcttcttattgaaatataacaatataggaaacacatacacagtacaacttgtaagtacactgctcaatcagatttcatctggatcaagaacagantattccaatattccggaaaagaaaagnaaacatgttaaaaaaaaangatttttatttaaaaaacctagnacatnggtanttaaantggggggttaagagagggtaatctctctatccctttgtgtgtgtgtggtatatatatatatatcatacataatcccatatctatggcatctttacccacccttttaatggtncccttttccggaatgggggttttgcnggagggcttttcttggggggggtatttggttttatttggttttaaagggttttgggggggggntaaccttgggggggtttcccc

SEQ ID NO: 830 - DNA, 464 bp, Homo sapiens
  Genbank Accession No. R42241
  unsure (1)..(464): n = a or c or g or t
ttttttttttttttgaaaacagaattatttattgcatacagcatgggactgtgatcaacctggncatcaaatgccgcgatggctgacagggcccaggcggcgggagtgctgggaagcccagtacacgtgctccctctctgtgggactccgggatccacggggcggatggttctntgagttgcgagttgttcctgtttgtcttccagcccccagtcctccccggccactctgattagccagcctagggtagggcctggcataaagtcacacaggcaaaccccagaagaaggaaaaagggcacctgcatgaacaaagagttgggttgcagaggntgcaccggggtaagacttccttcatgcagttnggagtccncccatgtngggacatcaggagatgncaccncacagaattggtngctaggttttnctgggttttggcccagagaggctnattcccattntttt

SEQ ID NO: 831 - DNA, 375 bp, Homo sapiens
  Genbank Accession No. R42336
  unsure (1)..(375): n = a or c or g or t
ttttttttttgtattttcttttaaatctttatttatccttttcattcctttatcccaccaatgcaaattgcggagaacagctggaagccacgtcagagcggcacaggccagctggctgagtgatgctgaccgctggctccgagcatcgagcatcgcagagatcacaacgggncatcagctctgggagctcctaggcgncaggcacagggctgctggaggcccgcagaggngcgcacntncccagncttnccacagtagtttggnccttaaaaacactaagnaacagttgncattcattgtctttttttttcttctttttttcctttaattaattaaaaaagaaaaccaaaacctcctataatttataagctatgt

SEQ ID NO: 832 - DNA, 318 bp, Homo sapiens
  Genbank Accession No. R42424
ttttttttttactttctgtgagcttatgaggccattctgcacattatcaaaatgaaatcattatgcagtaaccttatatatataaatccaattttttcctttgtagaagaaaaccaaaataattttacaaactacatttaacttagtaatataaagaactgactagtgtaaaattttgaaaatctaccactttattttgaagggaaaggtacacatccttcaaaaccccggctaacaattcctaggttcagttttctattatacaaatcaaaaggttaaattccttgtgggcactaaccaaaactttaaaaattaacg

SEQ ID NO: 833 - DNA, 490 bp, Homo sapiens
  Genbank Accession No. R42525
  unsure (1)..(490): n = a or c or g or t
ttttttttaattagaaggaaagaggtagaagacactgatgtctatttgttccaagattacgctctttgttctacacactgggtaacaataattgttcccaactaaagggccaggccagggactcgtagatgctgatggtcagcttttccttctcctttcttctcaatgaatctcaatggcccctaaccccaccaacatggcccagctggcaaacatctaatgtgggggaaagcagcaagatttgtgctgtaggggaataaacaccgaagttcagggagaatggggggccataaaccacacactgactgaccaaatggaccttgggacaaatcatttccaaacctaggaaatggcctccaacagttaaatgtggggttaggcttaaatccctttcccggaacagtgtnttgttttctaggctngaggtttgcttttaggtggaacccctttttttttnttattntttggccaggggtnaggggggcaagtt

SEQ ID NO: 834 - DNA, 243 bp, Homo sapiens
  Genbank Accession No. R42607
  unsure (1)..(243): n = a or c or g or t
ttttttttttaggctttgcaaaatacatttaatgatctctttcaaacaagtgttactcgngttttctttgctttctggagctaaatggggtatcgatgaggcagcagtcacgggagacccaacatgctcttggcagatactggattatccaactatcaaaaatggagctgtagaagaggcatgttnaactggttaaaacagaaagggtattttagtacggtcaagttgatctaagtacagagg

SEQ ID NO: 835 - DNA, 270 bp, Homo sapiens
  Genbank Accession No. R44397
  unsure (1)..(270): n = a or c or g or t
tttttttttgtattgtatacacagtggaaagctggttttatttgggagacaatgggagcttttacattgttgagcaaaggagtgacgagatcagtcttgctttttagaaagattagtttggcagttacttatttgtaaccaganttagacagcaaatcgggatgcagggggagaagtcaggtgactattagtctgcgagtaattctgggacaagagcagtggtaatggaattnaaagggattaaagtntttaccaggttttggcataaat

SEQ ID NO: 836 - DNA, 367 bp, Homo sapiens
  Genbank Accession No. R44535
  unsure (1)..(367): n = a or c or g or t
tttnttccaaaaatcaccacctttaatactccccggtcctgcacacacccacagtctcactgggctccaccctcacttactgcccgccgtggatggccttggaggctgcctgcccgcgccaggatgtttggcacaaagagcagccccgaagcccnctnaatgntctcgatgggcaccaggtaagcgntccagtgggatggcctnatccacaggtgcgttgggcatcacgtaggtgcggantncaatttgcccanctgntncctccaggttcagcaccttgaagaagtttgtgggcactgccangtggtttttgccgatgacctgggtantttacgtaggatttcccatcagnctctgtccatgggac

SEQ ID NO: 837 - DNA, 398 bp, Homo sapiens
  Genbank Accession No. R44714
  unsure (1)..(398): n = a or c or g or t
tttttttttttttttttttttttttgattttnagcaggnacagttttgattttattgcaaggcacacaatcgtatatacaatgcataattatcatcttttaaagtacaagataaaaatcatatacattatagtaaagancatatgagtatattcttgtttcagagangaaanttgccttaaggaagctgggttataccgtttttggatgtgattttcgtatttatactgaatcatccgaacagctcttggttaggaaaataaatctcattgatagggncacacaacctttcacaggctttcactttacaatgttccantttaaaggtcagccagtgtggctccctggattttggcatggggtcatcgttttttcatcccnggggtcttgggttggaaa

SEQ ID NO: 838 - DNA, 364 bp, Homo sapiens
  Genbank Accession No. R45654
  unsure (1)..(364): n = a or c or g or t
tttttttttgccatgtttcatttcctttaataatgaaaatccataagggtttaaaatactcttagacacacctagcttagcaaatatcatggacctctacatttatgtgaattcacacatgagctagccagcacctcagttctggctggccatcgacacctgcttctccctttggccctggggccagggagccctggaggccaggttcccctctgcctcctccaatggagttgccagcatcgcctttatctcccttctgccccaggaggccaggaagcccaggggagccttcagcccccttctcacccntntgccccntntttnccagcaaacctgggggccccngnttcccttttgttcctgg

SEQ ID NO: 839 - DNA, 229 bp, Homo sapiens
  Genbank Accession No. R45698
ttttttttttttttttcattataaaagtcagtttattttccctttctgtgtttcgtattttccctttttgtcagtaaatgagcaatacactgactggaaatctgcatgattaaataacattaacaagttcataaacacaccccatatcagagtataaagcaagaggttgaaaaatatcccctaaccgaatgccaaattagggtatccctcaaaattgcacattctccct

SEQ ID NO: 840 - DNA, 254 bp, Homo sapiens
  Genbank Accession No. R46074
  unsure (1)..(254): n = a or c or g or t
ttttttttttttttttttttttttttttttttattgccaaganccaaagaaaaaattttatttacaatagagaattttatttgaaacatgcatttcttgtttttttaaaaacaaatcagcaaatgcagatcaagtttacactccttaaggcaagagtccctatgcacgctgtacatgttcatattaaatccaaaagctgctcacccggggaacttgtgtacaaagggcaaggccaaggtcagcaatgtgtcttt

SEQ ID NO: 841 - DNA, 338 bp, Homo sapiens
  Genbank Accession No. R49138
  unsure (1)..(338): n = a or c or g or t
ttttnttttttttttttttgggagttgagatatttattaacagatgggggtgctgggggtgggctcctgccccagagggattgacaggtggatgccgggtggggagggctgcagggctggctcctggcctctntcctggcttcatggtcctgacanctctgggccancctcagggctgggagcgtactntagcaccancctttcaaagtcgttctccttggcctggtactccttgatgaagggatgggacctgtgggcatccttcagctgggacaggtatcggtttgtcacctcagggggnttgccaggntgctnggacaggacgatgaggttnacca

SEQ ID NO: 842 - DNA, 284 bp, Homo sapiens
  Genbank Accession No. R49327
tttttttttttttggaaaaagaaatttttttttaattagaaaccaagtttacatacggttaaatggttactaaaagctcagttgtaaccactcctaacaccactagcagaacctcaagggagccaagagctcttcccttttcccctgttaatttccagtataatgtagcagcacaattatttcatgtcacatttaagaagaacaagaaccaatttatataaaggtacaattgtatatccttaaacattccacataaacacactgtcaaaactcactggatatgc

SEQ ID NO: 843 - DNA, 414 bp, Homo sapiens
  Genbank Accession No. R51831
  unsure (1)..(414): n = a or c or g or t
ttttttttttccattttaaattattttattgtatattaaaaaaccaaataaagcaataactttaaagacctcacacacacacagtataaacacctgggtaaggttttnttcgtgtccatgttgacaccggaactaccgttaaagtgcaagttttgttttgtgttcctttgtgcagtttcactcacatgtaaacaagtcacttggctatgatttgacccacgcccccccgnttagtttcgggagggcagaggctctaccggctgtcacagcaacccggantcacagncaagntaatgccccgtgggtcctgaccctgcaagcggggcatgacggtttcttgangcctagcagaggntggttaactttcacatncctcccccaccccgtggttcactnttaggtttttgagaagtt

SEQ ID NO: 844 - DNA, 538 bp, Homo sapiens
  Genbank Accession No. R56183
  unsure (1)..(538): n = a or c or g or t
gtaagatggcggggtacgacttaactactcgcatcacgcaccttttggatcggcatctagtctttccgctccttgagtttctctctgtaaaggagatatataaagaaaaggaattattacaaggtaaattggaccttcttagtgatgccaacatggtagactttgctatggatgcatacaaaaacctttattctgatgatattcctcatgctttgaaaaagaatagaaccacagttgttgcacaactgaaacagcttcaggcagaaacagaactaattgtgaaaatgtttgaagatccagaaacgacaaggcaaatgcggtcaaccagggatggtaggatgctctttgactacctgggcggacaagcatggttttaggcaggagtatttagatacattctacacatatgcaaaattcccagtattgaatgtggggaattacttcaggagcagccagaatntctttatttttttcagagtgttggttcccgcaaccgacaganatgctgtaagttcactctgggggaagctggcctctg

SEQ ID NO: 845 - DNA, 375 bp, Homo sapiens
  Genbank Accession No. R56216
ttttttttttttagaaagaagttgtttaccactttaatagggctgtccaacatttggtcacatagatcatcttgaaatctaattgttttcatggccttcctatctcacaagaggagacctgaatactcttggaaaaagcaaaccaaacatagaaagagatgccatgataagacttgttgctacagcactatgtagttaacgatgccagactttggatttaatcagaggacatttctgcagtctaggacagctatacaaagccttaagacattgtatttacaggacttattcatgtagggatccatatcctacccataactctggccagagtcttaatagcatgggtgggagtgggctcccttaaggaatcctcat

SEQ ID NO: 846 - DNA, 364 bp, Homo sapiens
  Genbank Accession No. R56602
tttttttttgctgttatgattagatatttattgagcaccaggagagagtcagaacattagacttatagtggaggagcagaactgaaccctggcctgtgaaataacaatttcaattaaaagctgtctggccctgaagaaagagaaatgatcctggatatagctggtcctctgagctggcagagctgagcctccctcgggtcttctggtgggcaagatgccaaagttgaatagtgtctgtagggcatgatgaccaagtcctagtgctatgggcatcttccctctggtatttaggagaggagtaccagaagcccccggcagaggatactaggaagggcccagagccaaatccagcagctgggcttac

SEQ ID NO: 847 - DNA, 181 bp, Homo sapiens
  Genbank Accession No. R58878
  unsure (1)..(181): n = a or c or g or t
caaacaggtcatttgtttttattttatggatacaccaaaattttataatgagttgtgtttctattttggctttatcttccagaaacttagaaccaaatatgcagtcctcttctagcaactgtatgagagcaggtggtaagcttctatttnattgcccttgttttcccttgactccaaatct

SEQ ID NO: 848 - DNA, 485 bp, Homo sapiens
  Genbank Accession No. R59593
  unsure (1)..(485): n = a or c or g or t
ttttttttttttttttgccattgaaaagaaagtttaatgttacaattctccccagaaatgagggtcatggcatgccacagggggccacatgaaactctgtcacaagcagagaccacaaagcagagagaggacctgagactatgcctttattgctaagtcagtgggatggatctaggtggggatgtcccctgtttgggcataaagcaaaaacagacattctatggttgtcactgggaagtctgtgatatgagttttgtgcacccacgagagagggcttaaaaggatgatgtaaacaactttagcctttagtttgtccctgtacttaatatatgtcaaatagggcaaacacaaattctaaggtaaacacagattagttccgggagcagcttggcttatggcacacnttcagggaaacaccttggcttaaatcttacaggggaccacctgtttttttcaaactttggggttattccgtttctgacttt

SEQ ID NO: 849 - DNA, 372 bp, Homo sapiens
  Genbank Accession No. R60056
  unsure (1)..(363): n = a or c or g or t
ttttttttttttttataaaaggaaacagaccaacatcatagtgttttattgacaaaaccataggaaaaggcagttttaggatgtaaagtaaaaatggttctctgaaatatctacacaaacgtgaattctgaaaagttttcattaaaatcgtatttcatacaattataaactaatgaggaacaaaacaattttcaacttctccataacccagactgagcttgatttatgcttgccatacagaagcagganctcttcccagagagggtggtggctcccacacagctgacagccaggtttggctgtttacctaagccccatcttcccagtcggtgttcaaaacaagggcacaaggtctgggcttttcaaaaaaaa

SEQ ID NO: 850 - DNA, 387 bp, Homo sapiens
  Genbank Accession No. R60777
  unsure (1)..(387): n = a or c or g or t
tttttttttttttttttatttaaatggaaacactaatctttattttcatcatgctgaagtgtgtggttacaatttccaataaaacactatatataataagcaaaataagttagtacattgtaaacttatgcacagtttcatcaattaacagtttaagancaaacaagccatttaagactttggagctacatttagtaaaanattgcaaacactcaaatcttatcaaccccaagtaagacagtaaagagctattcaagacttcttcaaaccaattacacaantacatgtttatttttggttacagtcccctggctatgcacaaggaccattgggaatgctgggancaatttacacattttaaaaacgggcaaaaaggcaaagcaaggg

SEQ ID NO: 851 - DNA, 440 bp, Homo sapiens
  Genbank Accession No. R66690
  unsure (1)..(440): n = a or c or g or t
acatttcaaaatttagatatttaatagttgagaaaaaataaagaaacaaaaaatacaacaaaagagaatcacccataggtttcaggaacaaaatcattaaatggaaaaatgagaagaattctttatttttggaccaattttaggcacttaagagttttcttttcttcctttccccttgatcaaagtgaagatatgatagggaattcagaaatttctcttcttgaagaaagcagagataacctgtccatcctagtgaaagaaagcacaaacgattcacctgacggtggacacaaaatgactccttcattctctcagttctttctgctgtaatgaaattccacctgatacatctagccatagcacactgttaattactttgctatttattcagtaggctccncaagtggggaagcgttcttttgcccggggatttgtccggc

SEQ ID NO: 852 - DNA, 350 bp, Homo sapiens
  Genbank Accession No. R69417
  unsure (1)..(350): n = a or c or g or t
ttttgtggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctaattaggagatgcttgaagaactcaacaaaatcccaatccaagtcaaactttgcacatatttatatttatattcagaaaagaaacatttcagtaatttataaataaaggggcactattttttaatgaaaanaatttg

SEQ ID NO: 853 - DNA, 341 bp, Homo sapiens
  Genbank Accession No. R70212
  unsure (1)..(341): n = a or c or g or t
gcagttgggaagaatttattatcactaagtggccctgacagatcagggaggagggggtgacactaacgaggctgctacaatcagctcccctagaggcagcgattaagggctcattacccgctggggtgaggggagcctgggaaaggcagcggggcgnggggattaggttaggaggtggggcantttagagggaagaagagtgggacacccccaggggagtccaaggaggcctggcctggnagaagantnagnttaccctcccaccccccantggggannntatgactaaggaagcccccagaagggntgaaaggagantttcccagggaantgagnttaga

SEQ ID NO: 854 - DNA, 284 bp, Homo sapiens
  Genbank Accession No. R71395
  unsure (1)..(284): n = a or c or g or t
tggaaaaaannacaactttattttcagtcatttctatttccttggttatgaacaaaggtagcaaagtgcagttgtatcagcagtgccaatagaaattacagagtttttcatatccctttacagtttgccacaggtatcttaaaatattgtttacactcatctctcttcagtttaccattgtttaataggcctaccctcgatctttttattcaatatgttaataaagaaacctatacacatagtatcacgttatacattttaaaantnttttgacaactgtatat

SEQ ID NO: 855 - DNA, 480 bp, Homo sapiens
  Genbank Accession No. R71792
  unsure (1)..(480): n = a or c or g or t
atttattgcaaactccctaatatcacatgctagtgcgcttgnaatttcactcaggaatgttccgggatgggggccagaaggtagagagcaccatgaaagtacagcctgcgaggccggattgctaaggggcagacttcatgccaatggagggacaganttcaggaccagtctggatgggctaagctgccttgggcngnaaggagctggatcaggccagggagcttgaggttctcctttggccaacccaccccaggtttccagctcctcctcctcactcagggtcctgcgcggtgagggaggtttgggggaggttcgcggctntacagctgccagggnttttggggcactaccanttaagcntgaggcccccagtcagtccttcactnggggaaagtttccaagganttggggctttcactngcatttttttcagacangttccggntaaggggttnaagctttnccttnggggggttnccc

SEQ ID NO: 856 - DNA, 395 bp, Homo sapiens
  Genbank Accession No. R82942
  unsure (1)..(395): n = a or c or g or t
atttatttttcaggaagagaaacaggagacctcgaggcttctggacttaggaggnccgggcagctggnccatggttgtccaggnagtgccgcaggctgttggganaatccgttatgacgccagtggctcccacgctgaaggctgcttcaaaatccgactcttcattaaggcaccaaaagaccacctgcacccctcgctcctccaagtgtcggatcagactcttcctcatgatcagccatttcgaaaccacagccaataactgggttcaggcaagagcaggaaaatggggaaataggtcctnttgatgatnttggggcaggaagcagaagaagaacttctcagggattggggatgaagggcagcagcccagggtagtagggaaagcagcacccaga

SEQ ID NO: 857 - DNA, 392 bp, Homo sapiens
  Genbank Accession No. R84421
  unsure (1)..(392): n = a or c or g or t
acaaagagaaaattttattttcttattcttgaaatgactgtacgatttttcaatgttaaagttcactttcaagtatgatcaataacaagacatcaaatgtaaaaattatgctgtattatcattttctccattgcttcttaaaccactgaaagtaatttcacaattcaccacatttaggcatcttctttttcactttcttcattttttacttctttaggcaacaatggatcaatcttcagtaataaaccttcacttgttgaactacgaaggaaagcacgtaccacaangggacccaaattcaggcgggtctgtgcctacaaacttcattaataactgcttgcggattgggcagctatctgggtcacttgacatatccaatgttggctattttg

SEQ ID NO: 858 - DNA, 476 bp, Homo sapiens
  Genbank Accession No. R84968
  unsure (1)..(476): n = a or c or g or t
aaataaaaacagtaagcaaataacactgtgggcagcatacagaggtggcaaacaaataaagtcctgggttactaagaggaaccagggtgaagagtccagtctggatgcagtgggttggtgggcagcggcaaatctcgtcaggggctaagctgcagtagcggacccctgagagcccacctggggctgcagcctggccccgggcctgggagttggggctgccgntttccatgctggggtcctgctgggtccaatggggcacctgccctctggcccagctcattgggtgaagcatcagatgaggcgaggtggttccagccccctaaaccagggtgatgagggttcagcgaccttcggagccangcccagggtnagtttttgggatgccccagggttcctnaaacaggntcccngtccccagtttttcttttggaacaagcntgctggggtnctcccggnataagtgaatcagagttttt

SEQ ID NO: 859 - DNA, 412 bp, Homo sapiens
  Genbank Accession No. R85291
  unsure (1)..(412): n = a or c or g or t
ttgntatttacangtatttaaatgtgaatattcactacctatttgttgcangcctgcantttttatactgggcttgccaaaaacccgaacagctttctactttgacaatgtatcagaatttaaatcagcaatatgttaataagccaagcaaaggttatatatgcaaataaaactgttgtctataacctcctgttacactggggcacagcaaaagtcatggngtagtcgcatgtgaacctgtccctttcataggctgctcattgccggggaacatcagggaatagccatttgggaaggggtcatcagccctcccancatccgttttctgtcttgtcttttccctatgaggcagggggnaattccncggtggggccccaatccccagtgcaggnggctcagcctntggcctttg

SEQ ID NO: 860 - DNA, 380 bp, Homo sapiens
  Genbank Accession No. R88209
  unsure (1)..(380): n = a or c or g or t
acatcagtcagaaaattccagaaaatggaaagtactccatcatacagcaaagtaaatcaatggttgtttgaagagcagagagaaaaactttataaaggctccaagtaaatacaaaggtgatagattagataaattcattatggngactctgatgatggtttcacgggattataataaaattcaagacttatcctacagctcaaatatgtgtactttattggatgtcatttatatctttattttatttttaagatggggtctcactctatcacccgggctggactgcagcgttgcaatcctaggctcactgcaacctccgnctcccgggntcaagcaatcctcccacatcactaaggnccagggtacatgccnccctnccg

SEQ ID NO: 861 - DNA, 415 bp, Homo sapiens
  Genbank Accession No. R89291
  unsure (1)..(415): n = a or c or g or t
atggagtctcactctgtcacctaggctggagtgcaatggcatggtctccactcactgcaacctccacctcccaagtataagtgattctcccacctcagcctcccaagtagttgggactacaggcacgtgccaccacacctggctaatttttgtatttttagtaaagatggggtttcactatgttggccaggctggtcacaaactttgcccactttttaatgggattatctgttttattcctgttgagttctctgtatattatagatattagtcccttgttgggataaatggtttgcaaatattttcttccacttaacagggttgtatggggatagggattttttaaaaaaggagctaccnactgtgaaggggtaatatctcttaccttaaaggggccacatagggccnttttatc

SEQ ID NO: 862 - DNA, 379 bp, Homo sapiens
  Genbank Accession No. R89840
  unsure (1)..(379): n = a or c or g or t
ttaaattttattatagtaacaaagtgactatttttaataataaaagcagagtgcctgtaggaagtggatggccctatctcaggccaagtctccttagtgtttcagacctaggctgaccagaatagtcttctagaatgtaacatttatccaccaggngtcattatttaccaatctgacaagccactgggctgtctccgngcattcaatggttggaatcaaggctacagaccagantaggagatgaatgaaantagatttagaaaagggcgttgtggctggaatgcagcttgcagtgtgggagggcagggntgggagggtaaagagggctctttgaaagnccagtntcactttcctgatccaagtttcttaagctgatact

SEQ ID NO: 863 - DNA, 378 bp, Homo sapiens
  Genbank Accession No. R91484
  unsure (1)..(378): n = a or c or g or t
tcaaatgtcagatttctttattaaaatgtgcacattatagtttacttaaatacaaaatgttcactttccttgcaggtaagaaatttcactgacatttccatgtcaattagcttctttttaataaaaatccttccactgaaaataaatangcatttaanttactgaactattatattcattagtctcaatacctcttaaaatacttaaaacttgngaaaatagactctaaacatngcctaanggngggcatccagctctgaggcaggccacacaaggtgtgtctgaggtatgggccatatgactccgggggggccacctccacggacgggcccagccccaccgacggntctgctggaaaatcccggcccctcaggcggg

SEQ ID NO: 864 - DNA, 357 bp, Homo sapiens
  Genbank Accession No. R92737
  unsure (1)..(357): n = a or c or g or t
ttaatataaaagtaaaagagtacattgttgagtagaggattaaaggagtgacgaccctttctaaagtggggtctcccatcccggatccctaagactgtaacatctgctacatacattaaaancaaaacaaaacaaaagcaaacatgaaacttatgacctgacttcactccacccttcatgcctgcattatgacagaaacacgtcccactgctcctacttatgtatgtacatccagaggctccaaacctaaggctgtgggccccctcctcccaggccccacacacacacacccctggcacacacatggcacacacatggcacacacatggcacacacacacatacctggctggcccat

SEQ ID NO: 865 - DNA, 223 bp, Homo sapiens
  Genbank Accession No. R93908
  unsure (1)..(223): n = a or c or g or t
catatatnnaatantaaaaatcctgggaggcattgcactgtaatagtaagtctgcccatccaggntcatgcatgtcttttctttcattcaagtcttattttatatctttcagtaaattttcatatagatcttgtgaatcgaattatttttacatttcaaattcaactaacaattattaataganaatgaaaacattgatttttttcaatatttattttgtgtc

SEQ ID NO: 866 - DNA, 334 bp, Homo sapiens
  Genbank Accession No. R96924
  unsure (1)..(334): n = a or c or g or t
agtaaactttattngggagatggggtgaatccatcactggttactggaaccctgagtctgcattttctcctcaggaaggcggtctgaaatggagtgggctgtgtttggcaagggttgtagtggtttggaatctctcacctgcttggctcccgagctgggcctcaggctgntctccccagagtaaatgcccgggatcattgaggaagcgttggctgcgctgggcatgttagggcaggtctgtacggtccagcgctgtcccctgcagcgtctctgggcgctggggtgcaggtnaggcccnggacgaggagggaagagcagcctcgacagagagtcc

SEQ ID NO: 867 - DNA, 510 bp, Homo sapiens
  Genbank Accession No. R98442
  unsure (1)..(510): n = a or c or g or t
gtactcattaatcccctcctcaatttttaacagaattataaaagcaaagtcaaaaggtccttcaggatgactgggaggcttcctaggctaacttttgcatttgaaaatggaaaaaataaattacttgatatttgtgataagactaagatttcttaaaagtctgcacatcaatatattacctgggcttaggagggtgagggcacagtatccatctgcaccctctcctcgtattttttaaaaacaggcaaaatatgtaagaaaaggctggtgcacgttggaagacagagcgtgcctgtctatgccagtgctgctgtgccctgcagcctgggnaggatgggagtcggatgctggggcctcatgnccacttagggccaataacatactcaagactctacagccctttcaccagcaaagtatgncctgaggggaaccactgggtgttgggagttgaaggcacacaaagcaggggctaaagggcaattggggtttcacggtgcaggcgccttgagg

SEQ ID NO: 868 - DNA, 386 bp, Homo sapiens
  Genbank Accession No. R99092
  unsure (1)..(386): n = a or c or g or t
tgtagagacgttttgccctgttgcccaggctggtttcgacctgctgtgctcaagggatctgcccaccttggcctcccaaagtcctaggattacaggcctgagctactgcgcccaacccatttatttattnctgttttagttgcatttgctttaggagtcttagccatgaattctttgcctaggccaatgtccagaggagtttctcctaggttatattctagaatttttatggtttcaggtcttaggtttaagtcttttatccatcttgagtttatttttgtgtaaagtgagagacagggattcagtttcattcttctacatgtggctatccagttttcccagcaccatttattaaataggggtgtccttgcctcaatttatggttt

SEQ ID NO: 869 - DNA, 691 bp, Homo sapiens
  Genbank Accession No. S45630
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 870 - DNA, 1398 bp, Homo sapiens
  Genbank Accession No. S59049
tagatggcaacctccctatctgcccgcaggtcatagaggcgacacgtagcgtcatctgaccctgaagcaaaggcatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaaggcacgaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacaggctgtaagaatcaaagtcaactgacatctatgctacatattattatatagtttgtactgagctattgaagtcccattaacttaaagtatatgttttcaaattgccattgctactattgcttgtcggtgtattttattttattgtttttgactttggaagagatgaactgtgtatttaacttaagctattgctcttaaaaccagggatcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaaaaaaaaaaa

SEQ ID NO: 871 - DNA, 1644 bp, Homo sapiens
  Genbank Accession No. S75463
ggcacgagccggaagtgccttccagccgcacgcccttcctcttctgtgagctcgggctcctggtcccaagtggggaattaccggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccattggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagctttccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagccaaaaaaa

SEQ ID NO: 872 - DNA, 2469 bp, Homo sapiens
  Genbank Accession No. S77154
ttcggcacgagtgcacttcggcagagttgaatgaatgaagagagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctctgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttggaatgggtgggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactccaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttgcccatgcttggttgttgcagttcagacaaatgtgacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggccaaggcttgtaaatttacccaatgcagtttggctttttaaattattttgtgcctatttatgaataaatattaccaattctaaaagataagtgtgtttcccacaaaaaaaaaaaaaaaa

SEQ ID NO: 873 - DNA, 1223 bp, Homo sapiens
  Genbank Accession No. S81914
acactcgctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcggctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgcgggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgagcacagcccagctgggctaggcccggtgggaaggagagcgtcgttaatttatttcttattgctcctaattaatatttatatgtatttatgtacgtcctcctaggtgatgagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcattctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgc

SEQ ID NO: 874 - DNA, 290 bp, Homo sapiens
  Genbank Accession No. T03229
ggtgatctttgtggcattctctgtatttcctgaatctgaatgttgtcctgccttgctagattggggaagttctcctggataatatcctgcagagtgttttccagctcggttccattctgcccatcactttcaggtacaccaatcagacgtagatttggtcttctctcatagtcccatatttcttggaggctttattcgtttcttgttatccttttttcctctaaaacttttccttctcacttcaatttcaatttaatttcaaccttcaaatcaactgatacccctttctt

SEQ ID NO: 875 - DNA, 253 bp, Homo sapiens
  Genbank Accession No. T03593
  unsure (1)..(253): n = a or c or g or t
cgngcaaaagtgtttatttttctccttcagatatacantctattggggnttccgtgccactgaccaccatgtacaaggaagggnttcacaggcaagggggacaggtgagggcagcccccacttcactcaaggaacagggcaagggggcccagtacagagaacagaaatctcttacgacagcatcgtgccctggcagangattctgcatantcacctagaaatttcaattctaactgntttgatggaataatag

SEQ ID NO: 876 - DNA, 71 bp, Homo sapiens
  Genbank Accession No. T10695
tttttttttcagctgggctacaggtttattctggcactggaggtgaaagggggctggtgtggccagcaccg

SEQ ID NO: 877 - DNA, 255 bp, Homo sapiens
  Genbank Accession No. T15409
  unsure (1)..(255): n = a or c or g or t
ttttattgaaagttgaaaagtgaacagttaaataagtgacaccttaaaattgtgtagcgaaatgacagaaaatatgcatataactactatacaggtgctatgcagaaacccctactgggaaatccatttnattngttcgaactgcggatttttnaacgtattcaaccagctgaattgaacgatttcagtgnacacggatttactttagcgtattcagcagctagatttcagcttccacanngtgcgtnactgtgc

SEQ ID NO: 878 - DNA, 268 bp, Homo sapiens
  Genbank Accession No. T15423
  unsure (1)..(268): n = a or c or g or t
tttatttcattatcagtcttacaggttgctgaggttgggcaaagccagggtagtaacttaaatccaaagcacttttgtggagggacaacccgtttagcaaggccctgttactgaacagagggcagtggggggcaccccagggaccacagcacacagactagtgttagaaaccccttcccagaagcaaccggtgggacttggcccttaccagccaggggtctactccattgggtcttggggcccaccaacccctnttagaggnggnccc

SEQ ID NO: 879 - DNA, 537 bp, Homo sapiens
  Genbank Accession No. T15530
  unsure (1)..(537): n = a or c or g or t
ggattcccaaaaagcaatgacttcaattgttaaaaagaaaaaaagtatatgntgttttccaaagcaggacatacttcccaaatacagtttcaattcctccactatctaaagagaggcgcctattagagcgcttcataataccccgaagtcctcgtgaacacactccaggtggaaaattctgctgtgatgatgtgctaaaaaataccctataactcaaatattacacaataatcaacactaattaataaggtaattctacgcctatgatcacaaaacaggtgaaaggnaaacccagatgactttattcccagtttagagctcaatcattatcccaaccaaactctctccagaagaaaatttccacacagcctataaggggcactaaaatactttcccatccttcacagtcaggcagcaaagcaagcccacctgtaaattttttcaaaagctgttgantgtggaattttagctcaaattgtatgctgggcacctcagttcctgtttttccaggtcccggttttggncaatttttgtttt

SEQ ID NO: 880 - DNA, 246 bp, Homo sapiens
  Genbank Accession No. T15850
  unsure (1)..(246): n = a or c or g or t
aggaggggtgcgtttattagacaaacgctgggagacaggcctggtggggacctggctgggggatgatgcagcccgcaatggctgctgcttcgtacttggcttgccccggaccacagactcgtaacggtaacccctaacttttcaggggcctggnacccgcccctgccagggtccacacgcagagttatggcgggnccacccccacaggtgcagctctatctcccacctnttgcacagagatataag

SEQ ID NO: 881 - DNA, 311 bp, Homo sapiens
  Genbank Accession No. T16282
  unsure (1)..(311): n = a or c or g or t
aagctcagagtgacttttaatatgccaatcaatgttaataaaacacaagtcaaagacaagtgcaaacatgttttagaccaaaattaatgagaaaacagacaatttttttcaacatctgttagccagtattattagtcaaatggctaatcacagataaaatatattttgtgaaaaacttggaatgtcagangtcattctggcatttcaaacagctatgtacagtatcacgaagatcggtttatatacacaaatattgaagagaaaaaccgggcaaaacatttaaaaacagactaataatacaatcaagtata

SEQ ID NO: 882 - DNA, 240 bp, Homo sapiens
  Genbank Accession No. T16556
aaggtgattatatttattgatacttacatattaggagttaaaacaaatttaaaacatacgagtactgtacacgcaagcatgcatcccctgagtctgagtgaggctgtcactctagcatctggaatgctccgttgtatattcaggaggggacagtgaaaaagacaaataataatgtctttgtattatgaaaagttttgatctcatagatctcctgaaagtctcaggtatcccccgggggtc

SEQ ID NO: 883 - DNA, 250 bp, Homo sapiens
  Genbank Accession No. T17428
  unsure (1)..(250): n = a or c or g or t
gctgtgcagtagtatttattgttacagtgttaaaattcactctcggggaagcgatttggggccacggccctagaaactgcatctttgttcagagccaacccatttcctctgcagccacaaaatgcctttgtgtntcagggctcgggagattctcctcgntggccagccattggcaagaatgccagactcagaggttgccattgcccacaggctttntnctcctttcctttcacagcaggaagagccctcc

SEQ ID NO: 884 - DNA, 309 bp, Homo sapiens
  Genbank Accession No. T23468
tttgccaattatctccatgtttatttaaatatttggctctaaaggaagcaatcattcctttatacttctttaaatttagtattgacatttttattttgggaaaggaggtcttttttttttttaacatggatacaggaaaagaaaactctccaataaaaatattgtctaaaaagtttgttttggctgcatgatttactaaatatgtacaatttcaattcacagcgaaggtaacaaagatttaaacagccaacatcacaaatgtctcaagttctaaaaaaaaatcactgtgcacagtttaacaatttaatt

SEQ ID NO: 885 - DNA, 299 bp, Homo sapiens
  Genbank Accession No. T23490
  unsure (1)..(299): n = a or c or g or t
tttccaggttgacaggttttattccacccccttccatccccatggccaccccaggcaggaggagacaggtgtgctggagtctggtcactttggggcccggcgtgggcagagcccactgggtttacattctctgtgggcaggtgtggacaccagagggctggggcaggaggagcgtgggagcgagcggncgacccccgtctctggcccggcccctgggtaaacgccgactcagatgcctgaaacagacctgggccgagcaaggaaggttgatggtatttccacccagacagaaattcaaa

SEQ ID NO: 886 - DNA, 299 bp, Homo sapiens
  Genbank Accession No. T23622
tttatagaggagactgaaaaagataatttattccatcagaggcatcacaattacagattacagacatttgcaagtaaataatatgcagggttagagcgctgcgttttaacatttaacattcatgagtaaacagagatggccggtgggtaaatatcttgccaaggtggttccttgtattaagccttttgagtctaagatgacaaatccctaggggtcaggtggtttttcccgcacgaactcttgtcaatgagaaatccctcagccccttttgtcttgggtctcacagctccagaaggtga

SEQ ID NO: 887 - DNA, 309 bp, Homo sapiens
  Genbank Accession No. T23935
tttatgtataaacaggtaccagttttgattttatttaatcatttcatacattaacatacatgacacatcaaaatgagaaatgcacagtttaaccgttcaacagctggccttacttcaaaagaacactatattcatattaaacatttacagtctttccatctaactttacacatgtcctaaatcattttccagcacttctcacatagaagtctagttttgctctttaaaatcaccatctgtatcacccctagtagacgcgagggtttccccaattacatgctgaagagagccagccaccaccccacctaa

SEQ ID NO: 888 - DNA, 128 bp, Homo sapiens
  Genbank Accession No. T25732
  unsure (1)..(128): n = a or c or g or t
ctggcttttcctttcttcttatttttattgctcccaaatgtccactcatcgtcactgtcagacgtctccgagtctgacgaggctgcaggctgactcacaggcnnctccttcnnctcagagtcactgcg

SEQ ID NO: 889 - DNA, 207 bp, Homo sapiens
  Genbank Accession No. T32113
  unsure (1)..(207): n = a or c or g or t
ctggacagcgggcagcaccaggcggcggacagtgtcttccttctgcaggagcagcgcgnggctctccaccacctcctctccatccttggtccagcgcacctntgcccagggccggcatagctcacaggtcagcaccacacgctccaggcgcacggctgccacatacaccttgccgctgggatacacgatccacgaggagacgtctgt

SEQ ID NO: 890 - DNA, 308 bp, Homo sapiens
  Genbank Accession No. T33263
  unsure (1)..(308): n = a or c or g or t
gttcctttaaaggtttatttctggcaaataaaaaaaaataacttatgtggttagataaattaatgtatgtnattagatacgacacagggcagagctgaacgttcctgttttcttctggntcttgaaggttggtgagaggccgctgaatgagacccagcctcgtgttttgtgggatgaagagatgcagacaaagtgactcaggtacactgatgctccctggagggctgggaggtgggctcagaggaagaggccgaatccaaaccttttttattgaaaagaaatagctcttgtttgtagcatttaaaaga

SEQ ID NO: 891 - DNA, 280 bp, Homo sapiens
  Genbank Accession No. T40327
agaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctaaaaaaaaaaaaaaaaaaaaaaaaaaaa

SEQ ID NO: 892 - DNA, 271 bp, Homo sapiens
  Genbank Accession No. T40895
taatggtagctatcaatttattaactggttactgcggcaatatatataattataaaatcaccatcaatcctttcattcatacgttaacacatatcactggtttaattcattgaaggcaaatacaagtttttcccttactttccttccaagattccacttaggctggttaccccaaacgtaatggagaaacattaaatgtcacttttaaaccacttttaaaccagtctttaattttcaattcaggtgtgaggcacatatatacacacaaaca

SEQ ID NO: 893 - DNA, 343 bp, Homo sapiens
  Genbank Accession No. T40995
taatggttaaggaggaaggtttattggcttcaattccccagttgatgttcaacactttatttagttctcatttggattttaaacatttgcttgacaaataatttcccatcaatttccatttctttggaaagctcccacgtgtaatttatttttaacatctctgaagagcagaattaatgatatttcctagctgttgctccagatcatgtagggtagaggaggctgaaaactgctacaagggaaggcatctgtattgtttcaaaacgtcaggacggtacgggatactctttccagagcgacgagggtcaaatcccttcatttatttttttcaaaagggtaaaac

SEQ ID NO: 894 - DNA, 351 bp, Homo sapiens
  Genbank Accession No. T49061
  unsure (1)..(351): n = a or c or g or t
ggaccaaagaactttatatttattttaaatatcaaagtaacacaaagaactagttcaatatacagtacacttcctactcttcacagagaactgaaattttctataaagacatttatacttaggaaacatcagacaaccaaagtatgtataaaactcacaagatattttacacacagttcacaataattaattctgatattttaggntttttctgtcattgcttttaaagcatccttaatttaaaaacaaaaattattatttgaggactggaaaacaggtggcaaaggcatttctacttttaattatacactggtaaatccccccttaatccaaaacattttacttncacat

SEQ ID NO: 895 - DNA, 271 bp, Homo sapiens
  Genbank Accession No. T49291
  unsure (1)..(271): n = a or c or g or t
tgagaataatcagggagctttattatacaaaatggcggggtggggggcggcaanagcgggggacgagcatcaagcatcctgcatggccgttatcagcccttgacctgcagtttccccttggatctgggggggtgaccaccctctctgcacaggctgtnctcaacctcctaacttcctagaaggcacttggcctctccagggggtaagtccctttggccaatgatcaggagtttctttcctcccccaagtaacaagaagcggttggngttgg

SEQ ID NO: 896 - DNA, 423 bp, Homo sapiens
  Genbank Accession No. T49602
  unsure (1)..(423): n = a or c or g or t
tgaatattcaagaaaggtgaagtttaatttgcatataggcataacctacacctcacttggcaagtgttaggccacagcacaaacccctctgtccaatcacaaatgtccacaaatttgcaaagtaactggacacgaacgatatgcttctcaaactcacacacatattcgtccatcacacacacactcaaatgataaagaantacattgaaatcctctacaaaagagatctgaggacagtantcagatgacctcatgtgcggacagcctnttgcagtttacagtctaatccatttggtcctcacantagccctgtgaggataagcagcacagggattactnttcacaccgttttgcaggatgagggaaactgaggctcaggggatgtgtaaacaccagcctaaggttttccagttgggagactgg

SEQ ID NO: 897 - DNA, 413 bp, Homo sapiens
  Genbank Accession No. T50387
  unsure (1)..(413): n = a or c or g or t
ttttttttggtagaaatggggggtctcactatgtggtccaggatggtctcaaactcctgggctcaagcaatcctcctgccttagccttccaaagtgctgggattataggaataagccaccgcacctggcattcctggcctctcttattttatttaccttccaggaggtggtagacataactgattaataaaatctgaaagantttatctggcttagcaactttctcctcttgcgggcaggaactatccaaaagagtacatactcaatccaccagtgaagatggacaggttatcttcatgtaggcaggccaaacatttcccatctcattctattaactttttttttttttttttttgagccagagtctcactctgtcgccctgggctgggagtgcagtgggngcgatctcggat

SEQ ID NO: 898 - DNA, 404 bp, Homo sapiens
  Genbank Accession No. T53404
ctgtagcaatgaaaatttttaatttgaataaaaatcacgtaagcatgaggttgttggggaacacggaaaggaagggctcagattagggggtgtagcacatttatcaggaggtaagatctccatagtctcctacccctcctggcctggccttttactgtggtatccagcctctgggaagaccttgtatggacagtatctccactggggctatcactaggtgaccaggtaggggacagagtagagcagccaatgaccttaactcaaaatcttttctctcccttcaacctgtgaaaaaagatgactgggcacatactcagatgtcccctgggcatagcaccatcttgttggccagtcacaaacaccagctcttagttaagagggcctgggtttaaactcgtgccgat

SEQ ID NO: 899 - DNA, 309 bp, Homo sapiens
  Genbank Accession No. T53590
  unsure (1)..(309): n = a or c or g or t
ttnggtatgtggttcagctntttattntctccatggggtgggtgaagaggagtggcccagctgagctgaggaaggtgaccactgagaacccattcaacctgctgagcagcttgggcagaaaggagcaggacttgggacagacgactgaagatgcagagaccccatgggccccacccctgggccttcctcccatntggctgcaggcatcctntntnatcantgctgggttgcttcctggttaaagggccanaaggtnaaggagatgggnttttcangcatcagaatgaggttnaatttggtgcccacatc

SEQ ID NO: 900 - DNA, 457 bp, Homo sapiens
  Genbank Accession No. T54613
  unsure (1)..(457): n = a or c or g or t
gggctccagaccgcatttattcacctccaaagagggctgcagaccaagggcaccaccgggctccctccgctggcagggctgcatgccgggagccgtggtcacattagaaggtccgggagcgcagccaaggggncgtgtgcagcggccgtggacagagtgcagcgggcaagtcactgagcctcagtttctccatctagaaaaccgctgcggctgtgcggactgcatggcacgcagtgggctctcaggcgtgattgctcatccctctggcttggcggagggaggcctagagtcctgaccttcaccngaccccgccaacgtggcatcttgcttaccngccttcgggaggcagaaagggggcagcgaattagcaagccgaagcattgnacaattnggcccttnagggggccttgggcttncggctttaaccnggcgaacccccnagtttggccgacgaana

SEQ ID NO: 901 - DNA, 453 bp, Homo sapiens
  Genbank Accession No. T54617
  unsure (1)..(453): n = a or c or g or t
tttgagactttgnctgtctctgtcgccaggctggagtgcagtgggtgacagggtgagactctgtctaaaaaaaacaaaataaaacatgatgtttaataagtgctttcttgatataatctcactgtaggaatgccatgtttcgctggtgcacacactatcacagcacagtgattaccaaggaaatggagatccagaattactttattgttatgatcctgtaatcaaaataaagtaaaaactggggcttcaggccttgcctggggacctgtattttcactaaaagctgctactggcatagacaatgatcagtcatcacactctatgttaacaaacacagcacacacagcttgctgtntttcttgaggccgcccccagcagggccccagggccaaggcttgtgctggttaccaagggcaggagggacggatggcttgctngaccanagggtnttga

SEQ ID NO: 902 - DNA, 470 bp, Homo sapiens
  Genbank Accession No. T56281
  unsure (1)..(470): n = a or c or g or t
caggtntatnttntttaattatcactcacatatttcacaggaaaaggantntagcaaatgggtcaaggtggtntaaaaaaaaaatccaggtttntacatgtctctctgtttacatctgggagaaaggttntcctggcatcagtcgcagcagctgcacttctctgacgcccctttgcaaacacagccctgggcacacttgctacagcccacggggaggcaggagcagcagctnttnttgcaggagggtgcatttgcnctctttgcacttgcagggaaccagcgcagggtgcagggagacaccagcgggcgcagggagcagttggggggncccattgcaagcccgagggagagactgggacttttcccaaggagagaagcgaaggaagccagtggggggcagctcgtgcccganttccttcagccccggggggntccccctagttctaggagcggnccccaccgggtgggat

SEQ ID NO: 903 - DNA, 439 bp, Homo sapiens
  Genbank Accession No. T62857
  unsure (1)..(439): n = a or c or g or t
caatctnaaaaaaatattttcattatgtttattataaaaatataaatgtttccactacaaatcattttacattagtaagaggccatctacattgtacaacataaactgagtaatattttgaaaagacaagtttaaagtaaacacatattgccaatcatatcacatttatacatggcttgattgatatttagcacagcataaactgagtgagttaccagaaataaataatatatgtaaatcaaatttaagatacaaaacagntcatatgggtacataacatcatgtagggagttgtggcctttatgtttactgaaagtcaatgcagttccctgtaccaaagggatggccgtaggcattctaggtaccctctnctccctgggttagggaatccgtacacttatggtttaccatatggtccgggggtaggganttgtggtaa

SEQ ID NO: 904 - DNA, 450 bp, Homo sapiens
  Genbank Accession No. T62873
  unsure (1)..(450): n = a or c or g or t
tttttnacgagacagagctcagttctgtcgcccagactggaatgcagtggtatgatcttggctcactgcagcctcgacttctcgggtacaagcaattctcccacctcagcccctggngtagctgggactacaggagtataccaccatgcccaactcgtttttatatttttatagaaatggtntctcaccatattacccaggctggtctcaaactcctgggctcaagcgatccatctgcctgccttggtctcccaaagtgctgggnttacaggtgtgatcctctgagtctggccaatttttatttaaagatattttttaaattggactggacgcggtggctcatgcctggtaattaatcccagcaactttggggaggccaaggcgggatggctttagaccagcctggggtaacatgggcaagaccccntctctaaaaaaccaaaanaaggg

SEQ ID NO: 905 - DNA, 237 bp, Homo sapiens
  Genbank Accession No. T62918
  unsure (1)..(237): n = a or c or g or t
tttttttaagaatcttctgggcctctttattaagagccctctgccttnccaggggagggaagcaaatccttcagggcccccagagttcctgcaccccatatcatgggtgagnctaccagccacagagccacccgtcaccgtggagaggcttaagntgcactcagagctccccccgggcatgccgaatgtagtgttgatgcagccctgcttcctgagcaaagtcctgaccgcactctg

SEQ ID NO: 906 - DNA, 301 bp, Homo sapiens
  Genbank Accession No. T64211
  unsure (1)..(301): n = a or c or g or t
ttttttnntttgtggattttccttttaatgcaaaatgttgcaatacaaaacaatgtggagaaagcctgttcctcaggcactgaagggaggagtgaggaagagaggacagagctggacgtctcctcctatttctccctccccaagtcactctgaggggaagaacactgctgcctgctccctgggcctgccgcatacaaggttagagccctgggtctggggcatccttagcctgaaatttgttgacatggggcaggagagcaggagggaacattgagggttttgactcttcgggctctaaaag

SEQ ID NO: 907 - DNA, 290 bp, Homo sapiens
  Genbank Accession No. T64223
  unsure (1)..(290): n = a or c or g or t
gaatttnanagcattaagtgcattttattttattgtattagcacataaattgatgaagccacatggtgaaaatctgtgagaaactgaaggttttcatttgttttctgtgccccactgtatatcacctttcaaaataatgctttctgctgggtccaaacttcacttggagcaaagaaaggtagttaaaaggtttcacttaaagctacttcgttatgggtgctactgaaagtaaggtaaaagcaaacagcagtaacatggggactttaantgaggcaagagaagggattcag

SEQ ID NO: 908 - DNA, 257 bp, Homo sapiens
  Genbank Accession No. T65802
  unsure (1)..(257): n = a or c or g or t
gtcaaanggtgacaattttaatgactttatcaagccttaggacagagatgagagaaacacctttccaatgatgcatcaagttaacgtctaagcaaaagatcagcagagatcagagattgttgggtacacacgtatcttgtgatgtcttctgagaaccaacttattcctctttctctgagaagaacttgacccctcgccccggggctgagtgcttggcagccacatttgtgttgagatcttgattcctgctctaacta

SEQ ID NO: 909 - DNA, 445 bp, Homo sapiens
  Genbank Accession No. T67053
  unsure (1)..(445): n = a or c or g or t
ttctggttgtcaatgaggatatttattggggtttcatgagtgcagggagaagggctggatgacttgggatggggagagagacccctcccctgggatccctgcagctccagggtnccgtgggtngggttagagttgggaacctatgaacattctntaggggccactntcttctccacggtgctcccttcatgcgtgacctggcanctntagcttctgtgggacttccactgctcgggcgtcaggctcaggtagctgctggccgcgtacttnttgttgctctgtttggagggtttggtggtctccactcccnccttnacggggctgccatctgccttccagggcactntcacagctcccgggtagaagtcactgatcagacacactagtgtggccttgttggcttggagctcctcagagganggcgggaacagagttacagtgggga

SEQ ID NO: 910 - DNA, 444 bp, Homo sapiens
  Genbank Accession No. T67105
  unsure (1)..(444): n = a or c or g or t
ttancaaacatttattgattgcacaatgaaacaatctctcctttcagatatatacatcagtttactaaaagagtagatacaaaggtcaggaagtaattacaatgcaatgtgataagtttaataatataggtttgacagcatacagnggagggggtgattgggtttnaggtgatggtgggatattggccaggtaatatttcatggaccaagtgatgacaacatagggtttcacagatggataagagtcttccaagtntaccagggggaaatatacatgtgtgggtgccaaaacagagtatggcatttcctganagtcagannttnatacaagagtataaagtncaagagaatgggataagtagctagggaggtaaggccagacaggntaggcnagtcctaggggcctttcaggccatgggnagganaacgtggggcttcacccta

SEQ ID NO: 911 - DNA, 244 bp, Homo sapiens
  Genbank Accession No. T68873
  unsure (1)..(244): n = a or c or g or t
ntttttttttttttcaagtcaaaactgttttattgtcngtttacatatttaatagaaaaaggaatgtagcaaatgctcagggttgtatgaaaaaaaaatccaggtttgtgcaggttgctctgtttacatctgggagcagggctgtccccacatcaggcacagcagctgcacttctccgacgcccctttgcagacgcagccctgggacacttggcacagccatggnagaccaggagcagcagctc

SEQ ID NO: 912 - DNA, 346 bp, Homo sapiens
  Genbank Accession No. T73433
  unsure (1)..(346): n = a or c or g or t
gggagaaataaccagctattgttccgcattcaaacagaaattcaggtgcttgcatctttcacgtattgttcaaaaatcacaagcatctgtggaaaaaaactaaggtattacagacactacacggaggtcatgttcttacattcaagacactaaatacaaaccgangcantgcaaaattgtatactttaattttaaaacccantttttgttctcaacttgaaaagggnaacacttttttgtttcacaaacaagctgggtcgggttggganttctttttgggaacagtaggtcccgcgctaaacactgggttcttgcctccccacccccnttctctaaaatnaaccca

SEQ ID NO: 913 - DNA, 475 bp, Homo sapiens
  Genbank Accession No. T78398
  unsure (1)..(475): n = a or c or g or t
agtattgggtgtagttttatctgtcctttttttattcctttaatttaaaaaaaaaaaacctttaaactaggcaaaattactttccttttaacaaaaaccacattttcatgccttctgataacttttcttaaaccaaaaacatgtcctacttcccttatacactttcgatggagaattttttctcttgtatttagtaatttcaattatatacatttattacaatgttaacttttaggtaactcttatttttaggtgaaaaaccttgggagggtaggccgttttaattatggtaccaggatggcaaaggtccaggaacaaggggaccaagcgggggaggctgggcctagggtcataggccttaaaaactttaaatcttaagggataaaggggnggggggnacggtggggcctcacggnctggttaatcccggtgggttgggggaggggcgagtgggggtggggntcacngggggtca

SEQ ID NO: 914 - DNA, 445 bp, Homo sapiens
  Genbank Accession No. T79768
  unsure (1)..(445): n = a or c or g or t
ttttaagacaactacaaactttcaatattggaggtagctgcagagatcatggtaactgactttttcacagatgaggaatttaaggcccagaggaaggtaatatcagaattagtgacctccgcacccagcacacacacaggacaggggaaagggtgggagagatgcatgcactgggaccctgggatagattcaagatacccttgctgggggagggtggggctggccgttagttctaactcagtcttctcagtgccacctccagcccctgtgggtctttatgggggcccaactctttatccatctttccttggggtgatgggagggcatgttcgccagcattaaggatcttcccagncacaggatggcacggccccgggccttctttgatattattaggtgggcttctgggggntttcttccctgccgnccttccacaactcagggc

SEQ ID NO: 915 - DNA, 398 bp, Homo sapiens
  Genbank Accession No. T79868
  unsure (1)..(398): n = a or c or g or t
tgagatggcaacactgctttattaggccgggcagccaggagcagacacacggctcctcagtacacattcccccacccctgcctcggtgctccccactcagggctgggcatggagggggcagcgtaggtctggaagcgcttgtcncngctggtgcgtgangntctcagggacatggtntccacggccatctccagcccgggctgctgggttatctccactgtgtagtcattggccagctgcagggaggccagcatggaacgacacacctcgaaggccggctgnagnccaccagntccgcaaagggacaccactcattgagctgggggaaccntgagaccagntggtncccataggtttgggatntcaaagggcacatncttgctnctgctcctgggaca

SEQ ID NO: 916 - DNA, 272 bp, Homo sapiens
  Genbank Accession No. T82292
  unsure (1)..(272): n = a or c or g or t
ttttttatgtgtaagaagtactttaatagctcaaactcagagtcatcgtgctcccaattccaaagagattcctaaaagaggcaacttcggccgtttgagaagccagcgctcacccacccnnnnctctgtgcattgacctttgggtgctgacttggagaaaagcacaaacacgaccagtcccatnctggctcccgtgggctntcttctatctacgcattgtatcgactgcattagttggactaagatgatgactcagttaaaggaggagacaa

SEQ ID NO: 917 - DNA, 408 bp, Homo sapiens
  Genbank Accession No. T85532
  unsure (1)..(408): n = a or c or g or t
atcgcttgaggccacgagttcaagatgaggttggcaacatagtaagacctcatcactacaatttttttttttttaaattagtgaagtgtggtactgcacacccgaagtcccagctacttgggaggctgaggcaggaggattgcttaagcccagaaatttgaggctgcagtgagccatgattgcaccactatgctccagagtctaggcaacagagtgagaccttatctctttaaaacaaacaagaatgaagttaggtatctgtttatttgtttgagccatttgtatttccttttttgtaggactgtcctgtttnaaacgttaaaatcactgctgtnggttttngatttttacatctcagctgggatgggcaccaattaaattatttnaggccctggtttattgnaaaat

SEQ ID NO: 918 - DNA, 500 bp, Homo sapiens
  Genbank Accession No. T86121
  unsure (1)..(500): n = a or c or g or t
tttaccaggcccaaactaaacattcacatactcctcctttgagaagcaatgtgtgaaaacactaccacccattaagtgtaggctaatgccatttcagtggctttctggataatggagtaacggaaacagatttgtactgagccagacactctctattccccttggtgcaaaccctaaaaaagacatgtatattctggccagggactggggcattctcttagggaagccaagcagactacacctgtaacaatacatacatgctccaaccacatagggcaacctaactacagaaatgactgggcagcaaaatactagcttcatgcccactttgtatctacttggatcttttatgggctcaaccccggggagttgacctcttttagggggaggccttctaattttttcaccaacanctttctnaatacacacaggnttacanctttcaaccatgctctctgatggaggttaggtggctctccaaaaacacatattggtttacc

SEQ ID NO: 919 - DNA, 459 bp, Homo sapiens
  Genbank Accession No. T86148
  unsure (1)..(459): n = a or c or g or t
atttttatatgaaggttttctggtgaaatcttttaagcagggaggaaaatccaataaatttttttaaaaaggtttagctattccccaatgctatttaatacaattgaggttaggacgttaagtcttatcagactgtgtactggagccccgtgtcatcagcaaaagccgtgtgagtcaacaggtgtgaagactcaagatgcgcacacagacgctgtccgtggttttatggggaatgatgagggctggtcagttctcctcatgacaaaagtcaaaccgacttccctgtgttgcgtgtgaagcttgttagtggacagaggaggaaacgcagggttctgccctggggagnatgacagnccacagcgcttggggtnccgtcagggctttcgtgtncagttagcgtttcacaaactngaggaggagtattaaaanagcccaaaccccaaagtttctttttttcaa

SEQ ID NO: 920 - DNA, 375 bp, Homo sapiens
  Genbank Accession No. T87533
  unsure (1)..(375): n = a or c or g or t
ttggcattataaaatggttttattaattattaataactatttaatgtgtacacagttatccatgaagaaataggaaataccagtgagttgttaccagcgttgccccaggctgggagagcccttccagctttcctttggcctctgacacccctgccccactgaccgcccaccccccattcctgtctggaaggntcgcctgccatcatcccgcacatccgacagctctcccttcagggtcacctcctccttggacaaagcatacgtgaccccttgtcaggtttcttggctgggtgctcccccagagtttggctcctgccccaaccaagcatgcatgggtgacaatgcacccacttgataactgatcactgggggtca

SEQ ID NO: 921 - DNA, 357 bp, Homo sapiens
  Genbank Accession No. T89160
  unsure (1)..(357): n = a or c or g or t
atgctgctatgacagaatacccaagactgagtaatttataaagaaaagtaatttatttctacagtgccagggtctgggaaggtgctggtatctggtgagggctttcttgctgcatcattccatggcagaaagtgagagggtgagagagggacaagggaggggaactgaactcattcctttatcagtaacccactcctgcaataactaatccactcccacaataacaacattaatctattcatgagggcagagctntcatgacctagtcacttcttaaaggttctaccttaactccattgctttgggggattaaatttcaacatattaaacccttgggagggacacattccaaaccac

SEQ ID NO: 922 - DNA, 210 bp, Homo sapiens
  Genbank Accession No. T89243
gcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgta

SEQ ID NO: 923 - DNA, 494 bp, Homo sapiens
  Genbank Accession No. T89703
  unsure (1)..(494): n = a or c or g or t
gtagaaaacaaaaatggaacatttattngcaactcaaatactacgcatatacagtaagaanttaaatataaacacagcaagttccaccccagtcctatttgtccaaggctgcatggtcaaatggaatcttgaagagaacacctggncaacagagcanctntcagcgacgtctccggtctggacttctgctgcgtcttcggccacctctccncttgccttttggtggaccccgaacaaaacaccagtcaacggtgatgggctgtcccatcaaatcctgggccattgagtccctccatagcagcctggggcttccttgtatgtttcatattcagctaggagtatacccctgtcagatatcctgttcgcctgtcgaggttgaggatgaatgtttttaatttccccatattctgcggaatttgtcgtgtatgtnttctgcggnaggcttcctcatggacttccagttacaaagagantccagncttcagcagagcgtt

SEQ ID NO: 924 - DNA, 255 bp, Homo sapiens
  Genbank Accession No. T90038
  unsure (1)..(255): n = a or c or g or t
tttttacattattaacaaatttattgaacaactagaacttgacaagcacttgcccagtagaggggatacagtggtgagcaataatagtgatgataatgaggagcagttttccctagcaggcagcagttgaaaggantatgggtttaacatccaccantgaccaggngtggacagntccttttccagggngactgagtccatagtgggnttaaaaacatccctgtaattcttctagcttccttcatccaanttacc

SEQ ID NO: 925 - DNA, 391 bp, Homo sapiens
  Genbank Accession No. T90190
  unsure (1)..(391): n = a or c or g or t
tantnntccagctcttttattgagatcagtggtggctctgaaaagcgtntttngggttttagaagtaggcgttcgctaatttcttcttgggcgccgcttcttaggcttgacaaccttgggcttagcggccttggnttcacagccttagcagcacttttggcagctttcttgggcttcgcaaccttggccttctttgggctcttagcactttcttggttacagtggccgcggcggctntcttcgctttcttcggngttttcttagcgctcttcttcggagttgcgccgccagccgcccttcttgggcttcttggctnccccaactggcttcttaggtttgggtccgcccgccttttnaaccntggggcttggncttccccggagcttgcctt

SEQ ID NO: 926 - DNA, 483 bp, Homo sapiens
  Genbank Accession No. T90619
  unsure (1)..(483): n = a or c or g or t
gannntnntgggctcggcgtggtggtgaagctgtagcctcgctcagtgaggatctncatgaggtagtcggtcaggtcccggccagccaggnccagacgcaggatggcgtgggggagggcgtcggtacgaatgggcaccgtgtgggtgaccccgtctccagagtccatgacaatgccagtggtgcgcccagaggtangagggacagcacggcctggatggcacgtacatggccggggtgttgaaggtctcaaacataatctgagtcatcttctctctgttggccttggggttcaggggggcctcggtcagcagcactgggtcttcctccggggccacgcgcanttcgtttgtagaaggtgtnggtgccagatctttctccatgtccgtcccagtttggtgacgatgccatgcttcaatggggtantttcagggtcaggatgccangtttgctcttgggccttcgttcgccacgtagggaattct

SEQ ID NO: 927 - DNA, 233 bp, Homo sapiens
  Genbank Accession No. T90889
  unsure (1)..(224): n = a or c or g or t
natgaacagtatataatctaatctctttaattttatgtacatgaatataatgtatgtcaactttgtacatgagatacatatagtatttaaacattttactcaacaaacaagaatttacaatagcaatataactgactagagggctatcaacttaataatacttagattagatctgtactttaataggaaaagaatttaatagtttacaatcatagaaacactgacatttaaaa

SEQ ID NO: 928 - DNA, 305 bp, Homo sapiens
  Genbank Accession No. T94447
  unsure (1)..(305): n = a or c or g or t
ttaattatngatattccccctcaccgccctcagggancgggagaagtcacacgaccatagggagcttggacttggtggtcgtcacggtgctggcagacgagggtctttccaggaaccccttgctagaatcagccctcatacaagtgtgctcagagatcccaggagcgatggcatcctcccgaagtcactacccccatatgtctccttgggcttcttccccctctctttctggaacctgaccaggcagaacgcagcaactgncagcaacagcacgcccagggagcaccccaatcagagntccggcc

SEQ ID NO: 929 - DNA, 302 bp, Homo sapiens
  Genbank Accession No. T95005
ctttattgaaaacattgagtgcagaaataaaccctgctcatgaatgggaaaattcaattttacacaggtgctgattttatccagactgatctatagattcagctgggttccattctacatctcaaggggtttttggggggaatttgacaagctgattctcaaggttacatggaagagcaagggccgagactagagtttaggagatgattcccaaaggcacaggggcagaaaaatgaccagtggaaccacatagaaaaatcaattattgtattttcaatggatcactaggcagcagggaaaag

SEQ ID NO: 930 - DNA, 352 bp, Homo sapiens
  Genbank Accession No. T96171
  unsure (1)..(352): n = a or c or g or t
tgccatgttggcaggctagtctcgaactcctagcctcaagtgatccacctaccttggcttcccaaagtcctgggattataggcatgagcactgtgcccagcccatagatggcttttattaccttaaggtatgtcatgagtaaccttttaattctccataaaattaattattgtgttttttgtttgcttggttttctatgaccctatcataaattcaactccaaactctgcaccaattttttttaaactttactcaagaatttagggccacataaacattccaacaaatttgtcttcgtagggnaaatcttttccagagtttttncccactatggcctaatgcgcagnggtca

SEQ ID NO: 931 - DNA, 358 bp, Homo sapiens
  Genbank Accession No. T97243
  unsure (1)..(358): n = a or c or g or t
nngttatnaagttaaatctctttaatatcccaatacaaagtactgatgcaaaaagacaatgagaaaacccaggaagttggggggtggggggtggggagaggttttataaataaaaaaccccgagcagcttttcagaggcagaggagctaagagaagcagcagtccaaagtgaggaagggagtgtgtggctcctgggacctgccccttgtcccctcactcacagctgctcgtaaacacccctttcaaaaggggctgcaccctttggatatctgcttctttctcttggtccctggggacggcaactagctctggcttcaatcccctacaaaaattcctgagatcttcgggggaccccagc

SEQ ID NO: 932 - DNA, 348 bp, Homo sapiens
  Genbank Accession No. T98019
  unsure (1)..(348): n = a or c or g or t
ataaaatagggctggccanagagcactcaccgtctcccttttgagtttttcccgcttgngtccaattccacgagcagccgagctcgctccaagtcatgccggagccgctgccaggacttgagctgttctttaagggcccagttcttatcctcagaatctctctgtagaggcaaaacgaagatcagaggatgattagaaagccagaggaaaggtcaacagggagaagagagcccagggaaactcaggtcaagccaaaagagggagcacagtaatttatttggtagttgcctcaatctgtgttttccccaaggccttgggaagaattaaattcttttggtattgtntttt

SEQ ID NO: 933 - DNA, 307 bp, Homo sapiens
  Genbank Accession No. T98288
  unsure (1)..(307): n = a or c or g or t
tgagtcattggncttgctctgtcactcaggctgaagtacagagacacaatcatagctcactgctgtcccaacctgctggactcaagtgatcctctctcttcagcctcctgagtagctgaggctactggcatgcacccaccctgataggngttttttattttttagggatggggtcttgctatattgcacaggccagtcttgaaccctggggctcaggcaatccctccacctcagcctcctgagnaattggggactacaggtgtgaaccacggatgcctgcctaattttttttttttttttgagacag

SEQ ID NO: 934 - DNA, 160 bp, Homo sapiens
  Genbank Accession No. T99373
aagaaattatgcttgtctttctatggcaggaagtagaagtggttcaaaagggaccgggccagtcatcaacaaggaggcactcaggcctgacgtgcctgacagatcgaggctttctctagtactgtacagctgctttaaggcacagcatgtttatcaatat

SEQ ID NO: 935 - DNA, 3632 bp, Homo sapiens
  Genbank Accession No. U00672
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 936 - DNA, 2376 bp, Homo sapiens
  Genbank Accession No. U02020
cgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtgg

SEQ ID NO: 937 - DNA, 10172 bp, Homo sapiens
  Genbank Accession No. U03272
atggggagaagacggaggctgtgtctccagctctacttcctgtggctgggctgtgtggtgctctgggcgcagggcacggccggccagcctcagcctcctccgcccaagccgccccggccccagccgccgccgcaacaggttcggtccgctacagcaggctctgaaggcgggtttctagcgcccgagtatcgcgaggagggtgccgcagtggccagccgcgtccgccggcgaggacagcaggacgtgctccgagggcccaacgtgtgcggctccagattccactcctactgctgccctggatggaagacgctccctggaggaaaccagtgcattgtcccgatttgtagaaatagttgtggagatggattttgttcccgtcctaacatgtgtacttgttccagtgggcaaatatcatcaacctgtggatcaaaatcaattcagcagtgcagtgtgagatgcatgaatggtgggacctgtgcagatgaccactgccagtgccagaaaggatatattggaacttattgtggacaacctgtctgtgaaaatggatgtcagaatggtggacgttgcatcgcccaaccgtgtgcttgtgtttatgggttcactggtccacagtgtgaaagagattacaggacaggcccgtgtttcactcaggtcaacaaccagatgtgccaagggcagctgacaggcattgtctgcacgaagactctgtgctgtgccaccactggacgggcgtggggccatccctgtgagatgtgtccagcccagcctcagccctgccgacggggtttcatccccaacatccgcactggagcttgccaagatgttgatgaatgccaggctatcccagggatatgccaaggaggaaactgtatcaatacagtgggctcttttgaatgcagatgccctgctggtcacaaacagagtgaaactactcagaaatgtgaagacattgatgagtgcagcatcattcctgggatatgtgaaactggtgaatgttccaacaccgtgggaagctatttttgtgtttgtccacgtggatatgtaacctcaacagatggctctcgatgcatcgatcagagaacaggcatgtgtttctcgggcctggtgaatggccgctgtgcacaagagctcccggggagaatgacgaaaatgcagtgctgctgtgagcctggccgctgctggggcatcggaaccattcctgaagcctgtcctgtcagaggttctgaggaatatcgcagactttgcatggatggacttccaatgggaggaattccagggagtgctggttccagacctggaggcactgggggaaatggctttgccccaagtggcaatggcaatggctatggcccaggagggacaggcttcatccccatccctggaggcaatggcttttctcctggcgttgggggagccggtgtgggggccgggggacagggacctatcatcactggactaacaattctgaaccagacaatagatatctgtaagcatcatgctaacctttgtttaaatggacgctgtataccaactgtctcaagctaccgatgtgaatgcaacatgggttataagcaggatgcaaatggagattgtatagatgttgatgaatgcacatcaaatccctgcactaatggagattgtgttaacacacctggttcctattattgtaaatgtcatgctggattccagaggactcctaccaagcaagcatgcattgatattgatgagtgcatccagaatggggttctttgtaaaaacggtcgatgcgtgaactcagatggaagtttccagtgcatttgcaatgccggctttgaattaactacagatggaaaaaactgtgttgatcatgatgaatgtacaactaccaacatgtgtttgaatggaatgtgcatcaatgaagatggcagcttcaagtgcatctgcaaaccaggatttgtcttggctccaaatgggcgttactgtactgatgttgatgaatgccagaccccaggaatctgcatgaatgggcactgcatcaacagtgaagggtccttccgctgtgactgtcccccaggcctggctgtgggcatggatggacgtgtgtgtgttgatactcacatgcgcagtacctgctatggaggaatcaagaaaggagtgtgtgtgcgtcctttccccggtgcagtgaccaagtccgaatgctgctgtgccaatccagactatggttttggagaaccctgccagccatgccctgcaaaaaattcagctgaattccacggcctttgtagtagtggagtaggtatcactgtggatggaagagatatcaatgaatgtgctttggatcctgatatatgtgccaatgggatttgtgaaaacttacgtggtagttaccgttgtaattgcaacagtggctatgaaccagatgcctctggaagaaactgtattgacattgatgaatgtttagtaaacagactgctttgtgataacggattgtgccgaaacacgccaggaagttacagctgtacgtgcccaccagggtatgtgttcaggactgagacagagacctgtgaagatataaatgaatgtgaaagcaacccatgtgtcaatggggcctgcagaaacaaccttggatctttcaattgtgaatgttcgcccggcagcaaactcagctccacaggattgatctgtattgacagcctgaaggggacctgttggctcaacatccaggacagccgctgtgaggtgaatattaatggagccactctgaaatctgaatgctgtgccaccctcggagccgcctgggggagcccctgtgagcggtgtgaactagatacagcttgcccaagagggcttgccaggattaaaggtgttacgtgtgaagatgttaatgagtgtgaggtgttccctggcgtttgtccaaatggacgctgtgtcaacagtaagggatcttttcattgcgagtgccctgaaggccttacgttggatgggactggccgtgtatgtttggatattcgcatggagcagtgttacttgaagtgggatgaagatgaatgcatccaccccgttcctggaaagttccgcatggatgcctgctgctgtgctgtcggggcggcttggggcaccgagtgtgaggagtgccccaaacctggcaccaaggaatacgagacactgtgcccccgcggggctggctttgctaaccgaggggatgttcttactgggcggccattttacaaagacatcaatgaatgcaaagcatttcctgggatgtgcacttatgggaagtgcagaaatacaatcggaagcttcaaatgccgttgcaatagtggctttgctctagacatggaggaaagaaactgcacggacatcgacgagtgcaggatttctcctgacctctgtggcagtggaatctgcgtcaatacaccgggcagctttgagtgcgagtgcttcgaaggctatgaaagtggcttcatgatgatgaagaactgcatggacattgacggatgtgaacgtaaccctctcctttgtaggggtggcacctgtgtgaacactgagggcagctttcagtgtgactgcccactgggacacgagctgtcaccatcccgtgaggactgtgtggatattaatgaatgctccctgagtgacaatctctgcagaaatggaaaatgtgtgaacatgattggaacctatcagtgctcttgcaatcctggatatcaggctacgccagaccgccagggctgtacagatattgatgaatgtatgataatgaacggaggctgtgacacccagtgcacaaattcagagggaagctacgaatgcagctgcagtgagggttatgccctgatgccagatgggagatcgtgtgcagacattgatgaatgtgaaaacaatcctgatatctgtgatggcggccagtgtaccaacattcctggagagtatcgctgcctctgctatgatggcttcatggcttccatggacatgaaaacatgcattgatgtcaatgaatgtgacctaaattcaaatatctgcatgtttggggaatgtgagaacacaaagggatccttcatttgccactgtcagctgggttactcagtgaagaaggggaccacaggatgtacagatgtggatgagtgtgaaattggtgctcataactgcgacatgcatgcctcatgtctgaatatcccaggaagcttcaagtgtagctgcagagaaggctggattggaaacggcatcaagtgtattgatctggacgaatgttctaatggaacccaccagtgtagcatcaatgctcagtgtgtaaataccccgggctcataccgctgtgcctgctccgaaggtttcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaagatattgatgaatgctccttccaaaacatttgtgtctctggaacatgtaataacctgcctggaatgtttcattgcatctgcgatgatggttatgaattggacagaacaggagggaactgtacagatattgatgagtgtgcagatcctataaactgtgtcaatggcctatgtgtcaacacgcctggtcgctatgagtgtaactgcccacccgattttcagttgaacccaactggtgtgggttgtgttgacaaccgtgtgggcaactgctacctgaagtttggacctcgaggagatgggagtctgtcttgcaacaccgagatcggggtgggcgtcagtcgctcttcatgctgctgctctctgggaaaggcctggggaaacccctgtgagacatgcccccctgtcaatagcactgaatattacaccctgtgtcccggaggtgaaggcttcagacctaaccccatcacaatcattttagaagacattgacgaatgccaggagttaccaggtctctgccagggtggaaactgcatcaacacttttgggagcttccagtgtgagtgcccacaaggctactacctcagcgaggatacccgcatctgtgaggatattgatgagtgttttgcacatcctggtgtgtgtgggcctgggacctgctataacaccctgggaaattacacctgcatttgcccacctgagtacatgcaggtcaatggaggccacaactgcatggacatgagaaaaagcttttgctaccgaagctataatggaaccacttgtgagaatgagttgcctttcaatgtgacaaaaaggatgtgctgctgcacatataatgtgggcaaagctgggaacaaaccttgtgaaccatgcccaactccaggaacagctgactttaaaaccatatgtggaaatattcctggattcacctttgacattcacacaggaaaagctgttgacattgatgaatgtaaagagattccaggcatttgtgcaaatggtgtgtgcattaaccagattggcagtttccgctgtgaatgccctacaggattcagttacaatgacctgctgttggtttgtgaagatatagatgagtgcagcaatggtgataatctctgccagcggaatgcagactgcatcaatagtcctggtagttaccgctgtgaatgtgccgcgggtttcaaactttcacccaatggggcctgtgtagatcgcaatgaatgtttagaaattcctaacgtttgcagtcatggcttgtgtgttgatctgcaaggaagttaccagtgcatctgccacaatggctttaaggcttctcaggaccagaccatgtgcatggatgttgatgagtgcgagcggcacccatgtggaaatggaacttgtaaaaacaccgttggatcctataactgtctgtgctacccagggtttgaactcactcataataatgattgcctggacatagatgagtgcagttccttttttggtcaggtgtgcagaaatggacgttgttttaatgaaattggttctttcaagtgtctatgtaacgaaggttatgaacttaccccagatggcaaaaactgtatagacactaatgagtgtgtcgcccttcccggctcttgctctcctggtacctgtcagaatttggagggatccttcagatgcatctgtcccccagggtatgaagtaaaaagcgagaactgcattgatataaatgaatgtgatgaagatcccaacatttgtctttttggttcctgtactaatactccagggggcttccagtgcctctgcccccctggctttgtactatctgataatggacggagatgctttgatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaagttgcatttcaggatttgtgtccatatggccatggaactgtccctagtcttcatgatacacgtgaagatgtcaatgagtgtcttgagagcccaggcatttgttcaaatggtcaatgtatcaacaccgacggatcttttcgctgtgaatgtccaatgggctacaaccttgactacactggagtacgctgtgtggatactgatgagtgttcaatcggcaatccgtgtggaaatggtacatgcaccaatgttattgggagttttgaatgcaattgcaatgaaggctttgagccagggcccatgatgaattgtgaagatatcaacgaatgtgcccagaacccactgctgtgtgctttacgctgcatgaacacttttgggtcctatgaatgcacgtgcccgattggctatgccctcagggaagatcaaaagatgtgcaaagatctggatgaatgtgctgaagggttacacgactgtgaatctaggggcatgatgtgtaagaatctaatcggcaccttcatgtgcatctgccctcctggaatggcccgaaggcccgatggagaaggctgtgtagatgaaaatgaatgcaggaccaagccaggaatctgtgaaaatggacgttgtgttaacattattggaagctatagatgtgagtgtaatgaaggattccagtcaagttcttcaggcactgaatgccttgacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagagatattgatgaatgtaaggtaatgccaaacctctgcaccaatggtcagtgcatcaataccatgggctcattccgatgcttctgcaaggttggctacaccacagacatcagtggaacctcttgtatagaccttgatgaatgctcccagtccccgaaaccatgcaactacatctgcaagaacactgaggggagttatcagtgttcatgtccgagggggtatgtcctgcaagaggatggaaagacatgcaaagaccttgatgaatgtcaaacaaagcagcataactgccagttcctctgtgtcaacaccctgggggggtttacctgtaaatgtccacctggtttcacacagcatcacactgcttgtatcgacaacaacgaatgtgggtctcaacctttgctttgtggaggaaagggaatctgtcaaaacactccaggcagtttcagctgtgaatgccaaagagggttctctcttgatgccaccggactgaactgtgaagatgttgatgaatgtgatgggaaccacaggtgccaacacggctgccagaacatcctgggtggctacagatgtggctgcccccaaggctacatccagcactaccagtggaatcagtgtgtcgatgagaatgaatgctccaatcccaatgcctgtggctctgcttcctgctacaacaccctggggagttacaagtgcgcctgcccctcggggttctccttcgaccagttctccagtgcctgccacgacgtgaatgagtgctcgtcctccaagaacccctgcaattacggctgctctaacacggaggggggctacctctgtggctgcccccctgggtattacagagtgggacaaggccactgtgtctcaggaatgggatttaacaaggggcagtacctgtcactggatacagaggtcgatgaggaaaatgctctgtccccagaagcatgctacgagtgcaaaatcaacggctatcctaagaaagacagcaggcagaagagaagtattcatgaacctgatcccactgctgttgaacagatcagcctagagagtgtcgacatggacagccccgtcaacatgaagttcaacctctcccacctcggctctaaggagcacatcctggaactaaggcccgccatccagcccctcaacaaccacatccgttatgtcatctctcaagggaacgatgacagcgtcttccgcatccaccaaaggaatgggctcagctacttgcacacggccaagaagaagctcatgcccggcacatacacactggaaatcactagcatccctctctacaagaagaaggagcttaagaaactggaagagagcaatgaggatgactacctcctaggggagcttggggaggctctcagaatgaggctgcagattcagctctattaaccgttcacagacttgggcccaggctcaaatcctagcacagccagtctgcagaagcatttgaaaagtcaaggactaattttaaagaggaaaaataataataactcttgtttctttcctccctgtcttagactttgaatgttgaccctcacagggagggataatttagactctggtatggccaaagatttgagctcaaaggcaaccgtggttactgtattttttatataacttcattttaaaatatattaaaagaaacctaaatgttcaagatatcagcatatggcactaaatgcacaaaaataatgtgagcttttttttttttttcctgttagcagtctgtaacactttgggtattttgctatagttgctaattaaaaaaatatagatgtttatttatttttaatgcagtaatatatggagaaatgaacaaactatgtaaacaaaaagggaaactcacttgtttttctttagatttataaatttgagctattttttttagaggtgctttttaaaaatccaatagatacaagagatgtttcctttggttttctgccagtcatccagctgatacacacctgatcgattttaaagaaagccacacagagctgaatcgggcagtgctaatcaataatttaaaagacatgaatgtcattagatcctttataacgtagatcgaagccaaagcagctcatttgtgacaacatttcatatcaccagacacaccaggcaacagaagttgaagcacaaccactgtagcaaaataccttgactgcttgtgagaccattagcattgcaggccaaaccgtactgtatttccttctcataacctcaaggaaccatatgtgctacccacaacacctcattcttacccagggtgcgctgcgtcctcatggtactgtaggcagctgaagaaccgccgttcccttgaaagggaacacctggcattctgtggtgtttcgtgctgtcttaaataatggtgcatttattatgttcaagttatttcaggattgccatatgtgcaaacaaatcatgcaatgcagccaaggaatatatgttgttgttgttgttttaaacccattttttttttagaattttcattaatactgtagttatacaccatatgcctcattttatcatagcctattgtgtatgaaagatgtttgtacaatgaattgatgtttagtttgctttagtcatttaaaaagatattgtaccaggatgtgctattaagagcacgtatccattattcttctcaacccaagaacctgtttcctggaccagtgaccaaacctcatatgtgaaatggccaaagcacatgcaggctcctggttgttcctctcaaacctgtgctgaccaaagattagtaaccagttatacccagtattttgaggttttattgtttttttaataactaaaaaaaaactcgtgccgaattc

SEQ ID NO: 938 - DNA, 5102 bp, Homo sapiens
  Genbank Accession No. U03688
gcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 939 - DNA, 2490 bp, Homo sapiens
  Genbank Accession No. U04811
gtggctgggccctggaattgggatgacatggatatcgactgcctaacaagggaagagttaggcgatgattctcaggcctggagcagattttcatttgaaattgaggccagagcccaagaaaatgcagatgccagcaccaacgtcaacttcagcagaggagctagtaccagggctggcttcagcgatcgtgctagtattagcttcaatggtgcacccagctccagtggtggcttcagtggtggacctggcattacctttggtgttgcacccagcaccagtgccagcttcagcaatacagccagcattagctttggtggtacactgagcactagctccagcttcagcagcgcagccagcattagctttggttgtgcacacagcaccagcactagtttcagcagtgaagccagcattagctttggtggcatgccttgtaccagtgccagctttagtggtggagtcagctctagttttagtggcccactcagcaccagtgccactttcagtggtggagccagctctggctttggaggcacactcagcaccacggctggctttagtggtgtactcagcactagcaccagctttggcagtgcacccacaacgagcacagtcttcagtagtgcgcttagcaccagcactggctttggaggcatactcagcaccagtgtctgttttggtggctctcccagctccagtggtagctttggtggtacactcagtaccagtatctgcttcggtggctctccctgcaccagcactggctttggaggcacacttagcaccagtgtctcctttggtggctcttccagcaccagtgccaattttggtggtacactaagtaccagcatctgctttgatggctctcccagcactggtgctggctttggtggtgctctcaacaccagtgccagctttggcagtgtgctcaacaccagtactggttttggtggtgctatgagcaccagtgctgactttggcggtacactaagcaccagtgtctgctttggtggctctcctggcaccagtgtcagctttggcagtgcactcaacaccaatgctggttatggtggtgctgtcagcaccaacactgactttggtggtacactaagcaccagcgtctgttttggtggctctcccagcaccagtgctggctttggtggtgcactcaacaccaatgccagctttggctgtgccgtcagcaccagtgccagcttcagtggtgctgtcagcaccagtgcttgcttcagtggtgcaccaatcaccaaccctggctttggcggtgcatttagcaccagtgctggcttcggtggtgcacttagtaccgctgctgacttcggtggtactcccagcaacagcattggctttggtgctgctcccagcaccagtgtcagctttggtggtgctcatggcaccagcctctgttttggtggagctcccagcaccagcctctgctttggcagtgcatctaatactaacctatgctttggtggccctcctagcaccagtgcctgctttagtggtgctaccagccctagtttttgtgatggacccagcaccagtaccggtttcagctttggcaatgggttaagcaccaatgctggatttggtggtggactgaacaccagtgctggctttggtggtggcctaggcaccagtgctggcttcagtggtggcctaagcacaagttctggctttgatggtgggctaggtaccagcgctggcttcggtggaggaccaggcaccagcactggttttggtggtggactgggcaccagtgctggcttcagtggcggactgggcaccagtgctggctttggtggtggactggtcactagtgatggctttggtggtggactgggcaccaatgctagtttcggcagcacacttggcaccagtgctggctttagtggtggcctcagcaccagcgatggctttggcagtaggcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcagataccgctaataaattgcagtagtccttcccatggagccaaagtaccttggatctttgtccacacagcagtcaaggcagttatggcccatcagctgagggtgtcatgtgatggaaaaatctgtttgctgttcctgctttattgtttgctttctgtgtgctgtcatattttggtatcagagttacattaaatttgcaaaatga

SEQ ID NO: 940 - DNA, 541 bp, Homo sapiens
  Genbank Accession No. U05861
tagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacctactttcgtctccataacttctatgttttctttccttctgacacactagtgcccctaaattgtgatttgcctatacgtttagggccggggttggaagatgttaacaaccatttaagattcatttctgcagtgggagtgggtggagtttcag

SEQ ID NO: 941 - DNA, 1987 bp, Homo sapiens
  Genbank Accession No. U06863
gggcggggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacactttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatccttgctcccc

SEQ ID NO: 942 - DNA, 952 bp, Homo sapiens
  Genbank Accession No. U08021
tgaactctggatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 943 - DNA, 2643 bp, Homo sapiens
  Genbank Accession No. U09366
ttttttcctgagacagagtcttgctctgttgcccaggctggagtgcaatggcacaatctcaactcactgcaacctccaccccctgagttcgagcaattctcctgccttggctcccgagtagctgggattacaggcgcctcaccatgcctggctaatttttgtatttttagtagagacggagtttcagcatttgcaggtgattttgaactgctgacctcaggtgatccacctgcctcagcctcccaaaatgctgggattacaggcatgagccactgcgcccagccgagagttttaaagaaggtgaaagctcttcccttttcctaacctagcctggccttgattccgctgatctaccttctgagatatcatccttcttcagggagataaggaaaaaaagccacagggtcccggagagccaggggaatgttttgtgttacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagcagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccaggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttatgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaatcacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggcttcggttgtaataaacttggcttctttataaaaaaaaaaaaaaaaaaaaaaaaaaaaaaaaaaaactttagagcacactggggtaccggatcc

SEQ ID NO: 944 - DNA, 2156 bp, Homo sapiens
  Genbank Accession No. U10550
agcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggagaagatacatatgaacgaaccctgatggttgatggggaaagtgcaacgattatactcctggatatgtgggaaaataagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggcccttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacctccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttga

SEQ ID NO: 945 - DNA, 992 bp, Homo sapiens
  Genbank Accession No. U11861
gaattccctgaggcgggagaccggtggtctgcaccgtcctggagggagatatgagtggctggactctcagccagccactgggatgtgttcgggctttggaccttgaggccggagagagctcccgagaggaggcggcgcacgttcgttcttctgaggggacggtagatttgggggtttttcctctaggattctcgcgccgtttcctctgaagaaacagaaccagagagggaaggtgacctgaaagtcactgaataatttttttagagctgaacaagaatccaagcctgcaactgcaactgcagagacgagagatctttctgctgtctatactcttggaaagcacatcctaagatctttgcagattatctgtggaaggagaatgcctaaagtcaaacgaagccggaaagcaccccaggatggctgggagttgattgagccaacactggatcaattagatcaaaagatgagagaagctgaaacagaaccgcatgagggaaagaggaaagtggaatctctgtggcccatcttcaggatccaccaccagaaaacccgctacatcttcgacctcttttacaagcggaaagcctacagcagagaactcttagatatatgttataaagaaggcttagcagacaaaaacctgttggcaaaatggaaaaagcaaggtataggaaacttgtgctgcctgcggtgcattcagacacgggacaccaacttcgggacgaactgcatctgccgcgtgcccaaaagcaagctggaagtgggccgcatcatcgagtgcacacactgtggctgccgtggctgctctggctgacggtggctgctgctccaccctggactctggacttcgcaggttccttgcctgtcacgccacccccttcctgggagcagcgagcagtgccccaggcccgagttggagcacggtctctatggggaagcgttcgctgtctatcagctgtgatttgtaaaaataaaatctttaaatctctcga

SEQ ID NO: 946 - DNA, 395 bp, Homo sapiens
  Genbank Accession No. U12775
gcagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctgctcgaaggtgtgcggctgtttctgtaaaggtcccgaaag

SEQ ID NO: 947 - DNA, 2187 bp, Homo sapiens
  Genbank Accession No. U13220
agcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctcgtcctcctccaattcggccagcgccccctcggctgcctgcaagagcgcgggcggcggcggcgcgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagttcctgcaggcgcgcttccccttcttccgcggcgcctaccagggctggaagaactcggtgcgccacaatctctcgctcaacgagtgcttcatcaagctgcctaagggcctcgggcggcccggcaagggccactactggaccatcgacccggccagcgagttcatgttcgaggagggctcgttccgccgccggccgcgcggcttcaggcggaagtgccaggcgctcaagcccatgtaccaccgcgtggtgagcggcttgggcttcggggcgtcgctgctgccccagggcttcgacttccaggcgcccccgtcggcgccgctcggctgccacagccagggcggctacggcggcctcgacatgatgcccgcgggctacgacgccggcgcgggcgcccccagccacgcgcaccctcaccaccaccaccaccaccacgtcccgcacatgtcgcccaacccgggttccacctacatggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagagctacttgcaccagaacgctcgcgaggacctctcagtgggactgccccgttaccagcatcactctactccagtgtgtgacagaaaagatttcgtcctcaacttcaatgggatttcttctttccatccctcagctagcgggtcgtattatcaccatcaccaccagagcgtctgtcaggatattaagccctgcgtcatgtgaacggaaagaggccaagcgatggccgctctctcctctcccctcctcagagggggcagatagaaactgggacggattcaagtcacatgcacgcggatagcagtaagccacacacctgccacttagccagaatgcccaggatcgcgttggtcactgttatttgcctactgctggaagaaggacaaccgctggcaaggtagcgttccccaatctgaatacctgcaggctcccacatgagggagagggcagactcaggtgggaagatgtgccatgcgtaaggcatcaacgtgtatctgtgggatcttcgttgccttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataaca

SEQ ID NO: 948 - DNA, 756 bp, Homo sapiens
  Genbank Accession No. U13991
cctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcta

SEQ ID NO: 949 - DNA, 2470 bp, Homo sapiens
  Genbank Accession No. U15932
aatcgcgaaacccggcgagcggcgcgctggctatcgagcgagcggggcggaaccgggagttgcgccgccgctcgggcgccgggctccgtcgcggccgcagccccgcgggtcgccctcccgtgcctcgcccgcggacaccctggccgtggacaccctggccgtgggcacccgcggggcgcggcgcgggcgctgcgcggcggcggcggcggcatgaaggtcacgtcgctcgacggcggccacgtgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcgcggcgcgcgcggctcctgcaggagggcggcggcggcgtcgcggccgtggtggtgctggaccagggcagccgccactggcagaagctgcgagaggagagcgcgtttgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacttgcacatcacagccctgctgaatgtctcccgacggacctccgaggcctgcatgacccacctacactacaaatggatccctgtggaagacagccacacggctgacattagctcccactttcaagaagcaatagacttcattgactgtgtcagggaaaagggaggaaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggcccaatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataagccaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtcaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaactgtggacttctgggatttgcagattttgcaacgtggtactacttttttttctttttgtctgttagttatttctccaggggaaaaggcaataattttctaagacccgtgtgaatgtgaagaaaagcagtatgttactggttgttgttgttgttcttgttttttatatgtaaaataaaaatagtgaaaggag

SEQ ID NO: 950 - DNA, 2244 bp, Homo sapiens
  Genbank Accession No. U19495
gcacgggacaggccgggccacacccaccggggcgagctcggagggcggcgctctgggcggagggcccggcggctcggcccagggcgcgttacctcgtcgccggggccggagagggcgggcggaggcacggggcctggaggcgccaggcggaggatgcgggcgacacggtggcggcggcgaccgcgcgaccgggcgggcgggcgggcaggggcgagcggagggagggagcggactgcggcaggatctgtcgaggaaaaatcttgcggccggcgattccccgccttttaagcgcagcctgcactccccccaccccacgcaggggcgggccttccccaacgcgggcgcccactggccgccgcgcgccgctcccctccagctcgcctgcgcctctcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaatttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcattaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggta

SEQ ID NO: 951 - DNA, 3100 bp, Homo sapiens
  Genbank Accession No. U20350
actcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgcaaattcactaccgccttcttcttcatcggcttttttggaagcatattcttcatcaccgtcatcagcattgataggtacctggccatcgtcctggccgccaactccatgaacaaccggaccgtgcagcatggcgtcaccatcagcctaggcgtctgggcagcagccattttggtggcagcaccccagttcatgttcacaaagcagaaagaaaatgaatgccttggtgactaccccgaggtcctccaggaaatctggcccgtgctccgcaatgtggaaacaaattttcttggcttcctactccccctgctcattatgagttattgctacttcagaatcatccagacgctgttttcctgcaagaaccacaagaaagccaaagccattaaactgatccttctggtggtcatcgtgtttttcctcttctggacaccctacaacgttatgattttcctggagacgcttaagctctatgacttctttcccagttgtgacatgaggaaggatctgaggctggccctcagtgtgactgagacggttgcatttagccattgttgcctgaatcctctcatctatgcatttgctggggagaagttcagaagatacctttaccacctgtatgggaaatgcctggctgtcctgtgtgggcgctcagtccacgttgatttctcctcatctgaatcacaaaggagcaggcatggaagtgttctgagcagcaattttacttaccacacgagtgatggagatgcattgctccttctctgaagggaatcccaaagccttgtgtctacagagaacctggagttcctgaacctgatgctgactagtgaggaaagatttttgttgttatttcttacaggcacaaaatgatggacccaatgcacacaaaacaaccctagagtgttgttgagaattgtgctcaaaatttgaagaatgaacaaattgaactctttgaatgacaaagagtagacatttctcttactgcaaatgtcatcagaactttttggtttgcagatgacaaaaattcaactcagactagtttagttaaatgagggtggtgaatattgttcatattgtggcacaagcaaaagggtgtctgagccctcaaagtgaggggaaaccagggcctgagccaagctagaattccctctctctgactctcaaatcttttagtcattatagatcccccagactttacatgacacagctttatcaccagagagggactgacacccatgtttctctggccccaagggaaaattcccagggaagtgctctgataggccaagtttgtatcaggtgcccatccctggaaggtgctgttatccatggggaagggatatataagatggaagcttccagtccaatctcatggagaagcagaaatacatatttccaagaagttggatgggtgggtactattctgattacacaaaacaaatgccacacatcacccttaccatgtgcctgatccagcctctcccctgattacaccagcctcgtcttcattaagccctcttccatcatgtccccaaacctgcaagggctccccactgcctactgcatcgagtcaaaactcaaatgcttggcttctcatacgtccaccatggggtcctaccaatagattccccattgcctcctccttcccaaaggactccacccatcctatcagcctgtctcttccatatgacctcatgcatctccacctgctcccaggccagtaagggaaatagaaaaaccctgcccccaaataagaagggatggattccaaccccaactccagtagcttgggacaaatcaagcttcagtttcctggtctgtagaagagggataaggtacctttcacatagagatcatcctttccagcatgaggaactagccaccaactcttgcaggtctcaacccttttgtctgcctcttagacttctgctttccacacctgcactgctgtgctgtgcccaagttgtggtgctgacaaagcttggaagagcctgcaggtgccttggccgcgtgcatagcccagacacagaagaggctggttcttacgatggcacccagtgagcactcccaagtctacagagtgatagccttccgtaacccaactctcctggactgccttgaatatcccctcccagtcaccttgtgcaagcccctgcccatctgggaaaataccccatcattcatgctactgccaacctggggagccagggctatgggagcagcttttttttcccccctagaaacgtttggaacaatgtaaaactttaaagctcgaaaacaattgtaataatgctaaagaaaaagtcatccaatctaaccacatcaatattgtcattcctgtattcacccgtccagaccttgttcacactctcacatgtttagagttgcaatcgtaatgtacagatggttttataatctgatttgttttcctcttaacgttagaccacaaatagtgctcgctttctatgtagtttggtaattatcattttagaagactctaccagactgtgtattcattgaagtcagatgtggtaactgttaaattgctgtgtatctgatagctctttggcagtctatatgtttgtataatgaatgagagaataagtcatgttccttcaagatcatgtaccccaatttacttgccattactcaattgataaacatttaacttgtttccaatgtttagcaaatacatattttatagaacttc

SEQ ID NO: 952 - DNA, 8628 bp, Homo sapiens
  Genbank Accession No. U20734
  unsure (1)..(8628): n = a or c or g or t
ctacacagatagccctacatagacctttgcatccaggctggcacagaagcggcagaggctactcctgtctctcaggcctgggtgtcaggttggaccagcacacactctcacatgcaccctataggccagtcacacgcttgccccctggaccttgccaaggttctgtgggggcactgacaccccagtctgtctctgccccacagagatcctggcacttcctctctccaaacatcacccccacttccctccctctttgcttttgccacttcccctaggagcctagctcacagcctctgctcctgctggggtgggggcctgctataaagaggtcacccagggtcttgtgatgcccagtcccccaaggcttcaccagcagtggcagggatggaagcagcttcctgagaaactcccctcatgcccaaccatgtcagcctggagagagagaaagagagagactctccttcctgcttccaagaaaacctagcagcttctctccaggagaggggcaaaggacccccaaacacagaggtgggagagggaggcggctggtaggcagagttcctgggggactgccgggcctcagatccacacccaggggcagggacacgggagggaggctgggtgctgtgtgctgcgatttgtgggttctcgccctggcctgcccactgctgactcacaggcagcccccagcccagtttcctagtgagggccccactggtcagtggggccagcagggaggggggtcaccgggctatttataagaaggagaagtccctcgtgccaagaccaaaagccccaagacacttgtgggtgggggtgggtgaacttcctccttatcctgtgccctaggccccaggccctggggcactggggaacctgcgcagggacttcttagccaggtgctggtctggccagggcctggcagtacccagctgccagtctggacgctcaggccagttgggggagggggctgttctccaccctcctcgtggggccggcctggccagtggggcggcctggagggggtggtccaggcacaagggtgacactgcagaggcctggaaccgggtataccagcttggcgtnggncccccgccctccctgtctggcccaatctccaccccgtgctcaaacacccatgcagagtgtttgaggaaccctactcccacatgctggcctgtccacagagaccgtgcccctctgtctgtgccccaccacatttctcccccaattaaaggagacctcagtggggtgcggtggctcacacctgtaatcccagactttgggagcaggtggaggattagggcaggacttccagaccagcctaggcaacagaatgagacctgtctcaataaatataaaaaaataaaacttagcagttgtggtgtgcttgtagtcccagttactctggaggctgaggcaggaggatcgcttttacccaggagttcagggctgcagcgagctatgattgtgtagctgaactctagcctgagcaacagagtgagatggtcttgttttgtggccaggctggagtccagtgtcaagatcatggtcatgtgatcctcctggctcagcttcggagtagtggaactacaggacaccctcctgacctcagataatttttaaatttttttgtagagatgggggtcttgctgtgttccccaggctggtctcaaaaatttctgggtagggctgggcgaggtagatcatgcctgtaatcccagactttgggaggtgagggggcagataacttcaggtcaggagttcgagaccggttggcaacatggtgaaaccccatctctactaaaaatacaaaaaattagctggggtggtgggatggcctgtaatcccaactattcgggagggtgaggagaagaataggttgacctgggaggtggaggttgtagtgactaatatttccccttcactccaccctggcgacagatgatattttgtctccaccacccccccaacaataaactcctgggctcaagtgatccctccccctcgccctcccaagtctgagattatagacgtgaccccctgtgtttgccaaagtgagttctctttaaaaaacaaaaaaaggccgggcatgtgcccacgcctgtaatctcagtactttgggagactcaggcggtgatcacaaggtcaggagttcgagaccagctgaccaatatggtgaaatcccgtctgtactaaaaacaaaaattagctgggcatggtggcatgcgcctgtaatcccacctactcaggagtctgagcaggagaatcgttgaacccaggaggcggaggttcagtgaccaacatcatgccattgcactccagcctggcgacagagcaagactccatctccaaaaaacaaacaacaacaaacaacaaaacacccaaaaaaagagcccttcatgagacgccctgcctgcagctggtactgcatacatgctctctggttgtcattattcacaacacagtggctaatgctctgaagaccagacagcttggattatatctcaactctagtgacttctagctgttgacaccagacaagttccttaatctcctgtggctcagtttctcatctgttacatggggatacaaataacatgcattttgctggattgttggaagcagtcgatgacttattttatgttaaccacttagaagagtgcctagcccacagtaagagccatgtaagtgttggctattaaaataataattattatttctcagcctatctatcttaagtgtttctgagtcactgcgtgacactaaccttgaacccatttgtctctctgggcatctctccctgccctgcgcccctgcccccatacacccactgttccttgccctcctcctgggatggactctgtctgggatggcctcacctctctctaggactcccttgcatggccagccagcctggccagggctgaattactgtggcctcctggcttttgggacctgcaagttagcttcccaaggtgctgccctctggcctgccctgccctgcccaaccccccacacgctgccccgtgcgccccgcggggcccagccagatgtcagctgcagttattagcctgggggggagacacaggcctggcagtgtgcctgccagactcacaggctccggaatctcccttgagcctggggagggggaggggagccattcaagcaaggggaagaagggagggggcatttaggggtcacagggaccctccaaggacgggacgcccccagcttctgctgggaccttcctccagcaaggccactgcactgctggacttccccctgcccccacatagctcagtttctttttcgcctctttcgttttccttctctttcccacacttggtgagatctaggctgccccggaatggctgtttaacccctatcccttagcctctttcttaccctaaagaagagagaggctctcttcatcctccagaagacagagctgagctgagagagagagagagagacaaagagagagagagagagacagagacagagacagagacactaggcttctcacctcttggtctagtgggttcacacactaactgctcggaagtcccaccttaagtctaactgaagcctgaccgtctgcacctcgccgcagccttcccgggaaggggctctggttccctcatattctccccttagattttcaggtcttctctgactcggggaggaagctctcagatgacagagctactctagggaaggaggggggctccctctaggtattctggatgatagtaggatgggacctgcagactaaaacgagagtggggcccctgactcacatgagtgagtggggggtgttggggacggagctccagatctcctggcagaagggaaggcaccccacccgagggaggagcagccgccgttccagcccgccgcagggggcgggcatcggcccgccctctccgcgccccgtcggccgggggcgaagtccgacccaggcccgcgggcaggcgggacctgcgggctgggttgggccaggccgggctcgaggacgcagccccaaagcggcggggtggggcggggccgggccaggcggcgtgggggcccgggggcggcggtcggggctggtcgggactagcagtctgggggcccaggcgcgccctgggacctggcagatagtcgggttccccgcttctggctcggggccccaggacagcgctggtcccacctcttcctgtgccctaatatgggcggcggggagagacttcgggggccggcccgcgctcagtcctgcccgcggactcccgctgttgccatggcgaccaggccccgtcctggtggtccctcggccaatggaacactcccaagccgcctgcctccgcggtcccctgcaggcaccgcgggcggaaccattgcttgaggggagaggatggtggctggaggctgccgcggctgggcgggctccaagcacccgggcctccgcgggggctcgcacgcccaggttcctcttccgaggcgcaggatgcgacgggacccagggcggggcgcacggtcccgtagatccgagtgacggagacagggccgggctccttcccccggggctgttgccacacttcctgcctcttctttccccagcctgtttctaaggaagggagtggggttgggcgaccgcacccagccgtcgggctccaggctctaggagcgacacggtgttgggcaaagcagggtcaataggggagggttttaggatgggggacagagaatacagatgactaagaggttaccatcgagggggagcagcagtcgtggaagatccagcagtcctggtgcgcgggaccctcaaggccccctcctcacatgtcaactgagtacctcttattgtcttctctgctccgaagatgtgtcggccccttctaactctctccttcatccgggctagcagatgaccccagtggtccccaatttctggcagacatgtctccatcttctacctggcatattttacctgcctcagtgtaccccaggccgcttactagctttctgcatatctagacttcccctaatgcctccttcccgcttacggagagcctcagactctggactcagctcccatgagctcctggacccctactcatttcttgcaatttaatgggtcatgcagctccacccactcaccccttttgatctctcccctcctccgtcctgtgaaaattccagtcccgcatccttctgagcccgggacccccagtcaattcctgggtcaggtgtctccttaaccctcccgatttacagtgcttaaccctcatttctgctttttggggtctccaatggattgtcagtcctcctacccctctcgtatctgggtacctcaggggtttcttcgcacatactgggaccctcaccccacttgctgcgtaccaggtcctggtatttgtccagtggactccagggaaatcatcctcctcctgaaacccctcactcatgtgcctgggccccccagcacctccttccatgcgtaccccgaggtcctttgagcccctccccctgcagccccgccgagccaccgccccgtggccgctgtttacaaggacacgcgcttcctgacagtgacgcgagccgcctcctccccttccccacgctcgaggaggggggcgcgggggcccggctccggcgacggccaatcggagcgcacttccgtggctgactagcgcggtataaaggcgtgtggctcaggctgagcggctgggaccttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaatttctgttgtctttttttccaagctgggagggcggggggaaaaaaaaagcactggtttgcccccagctcagtgctgttggtggctcggtcctgtatgtgtccccctcgtcggttcggcgcaggcatcttgtggtcccagcccaggagtcccacccttcccgcgtccccagatctccagggttggatggttggggcgcgggacgcggtccagggacccaggagctgaaggcagggtgctccggccgagacttggagtgcgcaggcgcgtccccgcccagccgcgccgccggggctttccccgctgacgcagcggaagcgctgcccatacaaggaccgattctgcccagtgacgcgaccgcggtctctgggcagattccgggaatcccctcccccgctctgccgggcagggccgcggcaccgggaagggggccgggattttcccgggcaggcgactgcccgggcacggaaagccccaggcctgggtccagagcncccgcggtgggcgggcagcgctcctgggctccgggagccacccctgtgccaccttcaagacactggcgcctaggccccgccgcgcccacgccccctccgtctgacctgaccggggcggagggttgctgctgcctccgctgctttggcgacgccgtcccctctacccccaccccctccaggaagggcggcgcccgcctgccagtttcccctcacgggtgccaggccaggagcggggcgactgncaggtctggtcctgccggggcggntgctcgggccgctgggcgccgncaccgncctcgcgctgggtccctcccgcgcagctgggacacgtggaggtgggggtgggggtgctgtgctgctggccgcctagagggagtctggcggttcggggttggaagcccccagagcagtggagaaaaacaggtagagaaacagacaggcagtagttatggaacagacacttcatcaattcatttgtacaatacctaggaacaactagaccctggagacacagctggaccactccagacaagacaataaataaacaagcaaacatggttctttgggggtggtggtaagtgctagtaagaggaaa

SEQ ID NO: 953 - DNA, 1717 bp, Homo sapiens
  Genbank Accession No. U21128
gtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggtaaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggc

SEQ ID NO: 954 - DNA, 2129 bp, Homo sapiens
  Genbank Accession No. U23852
ggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtcccccgacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacattggccatgcacatatggactctgcacatgaatcccacccacatgtgacacatatgcaccttgtgtctgtacacgtgtcctgtagtgttgcggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgccg

SEQ ID NO: 955 - DNA, 2575 bp, Homo sapiens
  Genbank Accession No. U23946
tcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatggctcccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgccttctctgtagctagtacggctattgctgctgctcagtggtcatccacccagtctcaaagtggtgaaggagtcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctaccgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcattgagatggagtgagagagagagagagagagagatgacaaggagcacaagaagtggtccatctcccgaattc

SEQ ID NO: 956 - DNA, 1222 bp, Homo sapiens
  Genbank Accession No. U24169
ccgaacgcccgcagcagggtcagaagggaggtggccggtctccgtcgtgacctctgacggtttctgagcgttggcctttggcacgcgctacacccttttgctttggttctgccatgccgatgtaccaggtaaagccctatcacgggggcggcgcgcctctccgtgtggagcttcccacctgcatgtaccggctccccaacgtgcacggcaggagctacggcccagcgccgggcgctggccacgtgcaggaagagtctaacctgtctctgcaagctcttgagtcccgccaagatgatattttaaaacgtctgtatgagttgaaagctgcagttgatggcctctccaagatgattcaaacaccagatgcagacttggatgtaaccaacataatccaagcggatgagcccacgactttaaccaccaatgcgctggacttgaattcagtgcttgggaaggattacggggcgctgaaagacatcgtgatcaacgcaaacccggcctcccctcccctctccctgcttgtgctgcacaggctgctctgtgagcacttcagggtcctgtccacggtgcacacgcactcctcggtcaagagcgtgcctgaaaaccttctcaagtgctttggagaacagaataaaaaacagccccgccaagactatcagctgggattcactttaatttggaagaatgtgccgaagacgcagatgaaattcagcatccagacgatgtgccccatcgaaggcgaagggaacattgcacgtttcttgttctctctgtttggccagaagcataatgctgtcaacgcaacccttatagatagctgggtagatattgcgatttttcagttaaaagagggaagcagtaaagaaaaagccgctgttttccgctccatgaactctgctcttgggaagagcccttggctcgctgggaatgaactcaccgtagcagacgtggtgctgtggtctgtactccagcagatcggaggctgcagtgtgacagtgccagccaatgtgcagaggtggatgaggtcttgtgaaaacctggctcctttttaacacggccctcaagctccttaagtgaattgccgtaactgattttaaagggtttagattttaagaatggtgctctttcatgcctattatcagtaaggggacttgtattagagtcagagtctttttatttaggccagttgtcaagtgtcaataaaagcgcatcatgtaattta

SEQ ID NO: 957 - DNA, 2083 bp, Homo sapiens
  Genbank Accession No. U25265
agcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacagcctctgcctgaaaactggacagaaggacccagaggtgttctttcattttctctcttacctccaatctttcccctttcaagctacaggtaaaggctctaccaccat

SEQ ID NO: 958 - DNA, 1902 bp, Homo sapiens
  Genbank Accession No. U26173
gcccctttctttctcctcgtcggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggacgtgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgggaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacaga

SEQ ID NO: 959 - DNA, 1040 bp, Homo sapiens
  Genbank Accession No. U26174
aacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagact

SEQ ID NO: 960 - DNA, 2036 bp, Homo sapiens
  Genbank Accession No. U30521
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtccccccccccacctttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaactgtctg

SEQ ID NO: 961 - DNA, 426 bp, Homo sapiens
  Genbank Accession No. U30999
ggtggcaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgttgtggaaatggattaacatacccgtctatgcctaaaagataataaaactgaaatatgtcttcaca

SEQ ID NO: 962 - DNA, 1293 bp, Homo sapiens
  Genbank Accession No. U32674
ataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaa

SEQ ID NO: 963 - DNA, 2076 bp, Homo sapiens
  Genbank Accession No. U40372
acggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagctgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctagatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttacttgcccccaaaagaatattggt

SEQ ID NO: 964 - DNA, 2344 bp, Homo sapiens
  Genbank Accession No. U41518
cctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcaggccctccttcttttcctaacatgcaccttgctcccaatggtgcttggagggggaagagatcccaggaggtgcagtggagggggcaagctttgctccttcagttctgcttgctcccaagcccctgacccgctcggacttcctgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctctggagaggcttccctacacagggcctgctattgcagaatgaagccatttagagggtgaaggagaaatacccatgttacttctctgacttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttcctgggcctgggggttttccaagccctcagctggtcctgaccaggatggagcaagctcttcccttgctcatgagctcctgatcagaggcatttgagcagctgataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaaggagagggcaaccagaaggcccttaactatcaccagtgcatcacatctgcagcactctcttctctattccctagcaggaacttctagctcatttaacagataaagaaactgaggcccacggtttcagctagacaatgatttgccaggcctagtaaccaaggccctgtctctggctactccctggaccacgaggctgattcctctcatttccagcttctcagtttctgcctgggcaatgccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 965 - DNA, 1303 bp, Homo sapiens
  Genbank Accession No. U41804
ctgccaatgagctccgccgagtagcaccggggcagggctagcgcttaaaggagccgcgacccctttgcagaccagagggtgacccggatgatggcggccggcgcggccctagccctggccttgtggctactaatgccaccagtggaggtgggaggggcggggcccccgccaatccaggacggtgagttcacgttcctgttgccggcggggaggaagcagtgtttctaccagtccgcgccggccaacgcaagcctcgagaccgaataccaggtgatcggaggtgctggactggacgtggacttcacgctggagagccctcagggcgtgctgttggtcagcgagtcccgcaaggctgatggggtacacacggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaagggtggtgtggcctgggcattggag

SEQ ID NO: 966 - DNA, 771 bp, Homo sapiens
  Genbank Accession No. U43527
ctctctctctctctctctctctctctctctctctctctctctctctctctctctctctctcctcgtgccgaattcggcacgaggctgcccaccctctggacattcacccagccaggtggtctcgtcacctcagaggctccgcagactcctgcccaggccaggactgaggcaagcctcaaggcacttctaggacctggctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagccgccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctggggcgcaggtgcggggcagtgaacttcagaccccaaaggagtcagagcatgcggggcgggggcggggtgggggggacgtagggctaagggagggggcgctggagcttccaacccgaggcaataaaagaaatgttgcgtaactca

SEQ ID NO: 967 - DNA, 1443 bp, Homo sapiens
  Genbank Accession No. U45955
ctgcggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctgatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 968 - DNA, 741 bp, Homo sapiens
  Genbank Accession No. U46006
atgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacccggaattccgccgatactgacgggctccaggagtcgtcgccaccaagccgaattccagcacactggcggccgttactagtggatccga

SEQ ID NO: 969 - DNA, 174424 bp, Homo sapiens
  Genbank Accession No. U52112
gatccacccactttggcctcctgaagtgctgggattacgagcgtgagccaccatgcctggccctgtaacatcatattgacaataataatgtaggcactttggtaattgttttgtcttcctgagtggtatttctcaatgtgaactacaaagatacctatggccatatctaggatcgaagtcttttttttttttttttttgagacggagtctcgctctgtcacccaagctggagtgcagtggtgtggtctcggctcactgcaagctccgcctcccgggttcacgccattctcctgcctcagcctcccgagtagctgggactacaggcgcctgccaccacgcctggctaattttttgtatttttagtagagacggggtttcaccatgttggccaggatggtctcgatctcctgacctcatgatccgtcagccttggcctcccaacgtgctgggattacaggcgtgagccactgcgcccggcagatcaaagtcttactatgaacttccagggtgtaatgtacacagccctatctgttttttgtttgtttgtttgttttgagatggagctttgctcttgttgcccaggctggagtgcaatggtgtgatctcggctcacagcaacctccgcctcccgggttcaagtgattctcctgcctcagcctcccgagtagctgggattataggcttgcaccaccacgcccggctaatttttgtatttttagtagagacggggtttctccacgttggtcaggctggtttcgaactctcgacctcaggtgatatgcccacctcggcctcccaaagtgctgggattacaggcatgaaccaccgagcccaaactgccctatctgttttaagttgaggaaaactcatcctatcggcactttctcaggcatcagtcccaatcaagttatgttattataacagcctattaagtctccctggataacagacaaccctttgtttatctatccatactgggactggagagaacttacattgtacaattaatgaagtgacactatacctgtcttcgcagcctctgtctatatatgccagctttctatttgtctattgattagatgctgttcttttcatctgttctatagtcatactcccaatatctaattgtttccttaaatatgaatagacctgctaatgatgatattgtagaactgttttgtagctaatcgctgctgggctatgagtgagggcctcctacagcttgatgagattatgtcttcccagcattaaattattccaaacagatcaatttcaaagttaacaaataacatgtttgttagtaaaaatgtgagtcttacagtaattcaaataactactactgtggatagagcagccaatatcagttacaggaaaagtcctttgtggcaaccacaatgcaatcctcccaagagtccagctgcgtttttctttctctccgatggccctgtaggtgatcagtagcatttgaaaacattcctctcagcacagtggcagcccaggcctttcccctggaaaagctttgatgcagaggaaacctcccagtcaactgggatggtggacttctttggagggttacctccagatccttctgactttttaagtctcatggtttctaaagaagagaaaagccctattaagtattgagtatgattacgggaggattcagttaaatcaggcacaggaaggacaggcacagtggctcatgcctgtaatcccagcactttgggaggctgaggcaggtggatcacctgaggccaggagttcaagaccagcctagccaacatggcaaaatcccatctctacaaaaaatacaaaaaaataaaactagccaggtgtggtggcacatgcctgtaatcgcagctacttgggaggctgaggcagaagaatcacttgaatctgggaggcagaagttgcagtgagttaagatcatgccaccgcactccagcctgggcaacagagcaagattctttctcaaaaaataaaaataaataaaaacattaaaaaaaatcagccacaggacttggtcttggacccaagttagagctaggccatgcttgcttaaaggagtggctgtaattttaaacaaggctagtgggaaagttccaggccatcttaacattgtaggttgcagaatcttagccaatgagtctttcagagctggattcattaatctgttaattaattcattaatttttttatgctactggatgacagtaggaataaaatgactttttctgtctgattcaaatgctctggtattccaaaagggagattcatatttattaagagagtctttcccgttgtttatacttcctgcctaaggatcagcttctttttctctttcttcacagctgacaacagatgccctaattgtttcacctcaggttagcactattgcaatttgtctagcaagaccttatgtccccgccagatgagaaattgcagtaaagccaaagcatcagttttgcattgctcttcagtttctgaggctactagtagcaagtcgtctacatagcaaataatcatagatccctctggtgggagaaattcctctaagtgtttctgtaaatgactagagaaaataatgggagcattcaaaacccttgaggaattctttgccataaatatcagactttctcataagcaaaagcaaacaagaatttagattcatctgctagaggaatggaaagacagaaaatgcagaaaattgatcaattacagagaaaaactttgcagacaatggtaccaaagtcagaagagttgctggagtaaacagaacagcacacatatttacttctttaagtttttttttttttttttttgagacggagtctctctctgccgcccaggctgaggtcagtggtgtgatctcggctcactgcaacctctgccccccgggttcaagtgattctcctgcctcagcatctcaagtagctgggattacaggcacgtgccaccacacccagctaattttttgtatgtttcttagagacagggtttcaccatgttggccaggctggtctcgaacttctgacctcaggtgatctgcctgccttggcctcccaaagtgctgggattgcaggtgtgagacaccatgcccggccttctttaagatcttatacaaataaatttagcagttgaccatcttcatcacttttacctctcttctctttcagaagtgtgagactatttcaaagtggtggctttttcaaattatcccttgtttctctattttttttttttttttttgagacaagatcttgctctgtcgcccaggctggagtgcagtggcaccatctcaactcacagcagcctcaacctcccgggctcaagagatcctcccacctctgcctcctgagtagctagggctagaggcatgcaccacctcgcctcgctaatttttctttctttctttctttctttctttctttctttctttctttctttctttttttttttttttttttttgctttttgtagagacagggtcttgctatgttgcccaggctggtctcaaactcctgggctcaagagatcctcctgcctcgacctcccaaagtgctgggattacaggtgagcccccacatctggcctctaattcttttataacctatttcattccttctaattgagctcccaacaaaggagattgttttacacacagctatggcttatccctttggtaaattgattttatgggttctatagctcaaattaaatcagcatctcgattctctagggctcaaaagatgccttgatttgtgtcagctcaggaagggggcttttccggcactgaatatggtaggcttggaggtgcatggcaggtctctcgccaataggtttacagaagagtcaggaggaaaggggagcacttgctccttaggcaaaggcagagggcccatctgatgggaattggagggaagggaatatgtagaaggctgagtcaagatacaaacaacctgtactgatggaaagcaagagcaagagctttccaaggcaaatgcagaataagtagcaccagtctgtatgagaaaaggcaaggacaggtcagcctggcaaacagtgaccgacatacacacacttaaccctaatctcttcccgccactgccatctcctcaatctatccattttgagccatttgcaaagtatctcctagctgagagttttatcctcctaggcccccacccctgattctcttgttcctgccatcctgcatgccccagtctctttggacaatccctcttccaatgtccttgcttcttgcaatgatgacacgtgtcttgcttcctttcctttctgggttgcccagaacaggagttactccctttcagtaaacagacctgagcagctaacacagagtttttcagtttcttcttttcttctttgactttctctagagtcccaaatactgaatagctgctcctaagcttacattatagtcagtcctgccatcctaccaccttttcccttatttgagttgttgttgttgttgttgtttgttttgtttcttgttttgagacagagttttgctcttgttgcccagggtggagtgcaatggcaccatctctgctcactgcaactgccacctcccagcttcaagcagttctcctgcctcagcctcccgagtagctgggattacaggcctgtgccactatgcccggctaattttgtatttttagtagagatagggtttcaccatgttggtcaagctggtctcaaactcctgaccttaggtgatccacccacctcagcctcccaaagtgctgggattacagcctcccaaagtgctgggattacaggcgtgagccactgcgcccagccatattggcactttttaagccttgtgttttttaatgtcccgttgaccaaagcaaatcacatggccaagcccagatctgagagtgtggaaaaatggactctatctcttgcagggaggagctgaaagttccatcacaaaagggtatgcatccagggatggcaagaatttgaggccatttttgtgatccaaggacagagattgtcctcggacataaaattcaaggctggcagtttttttgttgttgttggcacatcagatataccattgtcttgttttctggcttctgtagtttgtgttgagaagttggctgtcagtcaaactgcataactataaaagtaatcaacccacccaccagctgctttgaatgttttctctttgtctttgctttccctcagttttactatgatgtgcctaggtgtggttttttgtttgttttatcccgctcttggttcacgtgacttctagaaactgacttgatatatttcaccagtttggaaatatttcatccattaactcttcaaatattatctgtgccccattctttctcaccttgtttttctgaactccaattaagcatatattaggtcaagcatggtcgctcatgcctgtaatcccagcactttgggaggctgaggcaggaggatcccttgatcctaggagctcaagaccaacctgggcaacatagtaagacctcatctctacaaaaaaaaaatgaacaaaattagctgggcatgattgcatgtgcctgtagtgctagctactcaggaggctgaggcaggaggattgcttgagctcaggaggtcgaggctgcagtgagtggagattgtgccactgccctccagcctgggtaacacagcaagaccttgtcttaaaaaaaaaaaaaatacacgcacacacacatatatgagaccttctttctgtatcccctatgtttcttacctccttttgcattgtcttttaccacctttttacctctccaagctttagtctggctattttcttctgatttatctttctgtttactatttctctcttcagctcttgtatatcccacccattgagctcctaactttaatttgtatattttatatttctaaatttttcactagattctttttgtagtttcaaattatctgctaaatttctcaattctgtcttttgtttccttgaattattaaatataattattttaaagtctgtatctgataatgccattatttggagtccttgtggctctatttttattatattacttttctaatttcatttttattaaattttcttttctccttatgacatgttttgtttgtttttaagacagggtctcacactgtcacctaggctggagtgcaatcatagctcactgtaacattgaactactgggctcaagcaatccccctgcctcagcctcccaagtgctgggattacaggcatgagccaccatgctgggccttgtcctcgttattttttattgagtgctggacattgtgaatggaaactataaatcatttgaggccaaggacaatgttatcttcctccagagaaaatttacatttgtttctggcaggcagctggggcactagaaatcctgatcaccttaatccaattttcagggattgaaagagctcaaatcttgactacagtcccttaggggacagggatgcagtcctttagagggctattctatttccagtttacacttattcctagacctttgggtttccaacccaaagcacgaggagcttactagggccttcttccttggtgagccctgcactctgacttttgacccctcacctcttaagtctgctaactgttctgctcagcttcttgggccctcagctgtctctgctggaattagcggatggccataggggataagcagccttaaatgctgagctcatctctcagctcatttcctttctcccatatcttggtcccatatgcttcactgcctattatcacttggatattttcaagcaaatattttccctgttttactgagtctgtttagttgttctcagtggaggttgtggttcaaattacttattttgtcattgccagacacagaagtcattcagcactaggttttaggctctatttatattgttgagtctacatataatcttgcttccaagtactgcataacactccctaatgttttatctgcttccttagtcactacaaataatgctaccatgacctttgtcatgcaggccattgctctgtcacccaggttggagtgcagtatcatgaacatggctcactgcagcctcaacctcctggactcaatggatgctcctgcctaagcctctcacgcagctgggaccacaggcataagctaccacacacggcgaatttttgtattttttgcagagatgaagtctcaccatgttgctgaggctggtctcaaactcctgggttcaagtaattctcccacctcagcctcccaaagtgccacgattacaggcgtgagccaccacgcccagccaagaatttttgtgatgtatccccaagagcagaattacagagaattaccaaaattacccaacctagtgtatacttaattgatgagatactgacatattgttctccagaatggttgtgttggtctgtatctccaccagcagtacatgagcgctctctagccacacatccctgccagcatttgctattgcctgcatttctaggtgtgtgtgtatttgtcaatctaatgggtatgaagtgatactgttgttttgatttgcgttcctctgataatcaatgggcttgcacatcttgggtgtggcatgtctgctgctggtgctgccaacacttggtggggcatgtagaactgggcctctgacctccgaggaaggggtgtcatctggcgggttccgagaaggccgaaatgagctggagcctgaaaccactgctgctgctaagggccaactgagactggcgctacagcaacaggaatggaaaacaaacaggaaggagcaagacccttctctccttcccagccttccagtctccctctagtgtcccagttggtggaaactgacaaccagccagaagacaaagaaggaatgtaggttcagagtcccagcgccagcctcacaaagcagagtatggcaccttccccgcccctgcccctttggcttcgcaacatcagttcgaagccttcttgcataatttgaacttccctcagcagtaatgacaactttatgtttctgcctaacaagatccttcatacaaatatgctcctaccctcttctcaagaggggagacataaagtcccaacagtctttgtaatcatctccaaattacagtcacggtattggtgatattaatttctcctttaaataagtcatagtaccacttaactattctgtgacctagaggctaagttgtaaagtttaccatcaaaacaactgctattggccaggtgcaatggctcacgcctgtaatctgagcactttgggaggctgaggcaggaggatagcttgagcccaggagtttgagaccaacctgagcaacacagcaagaccctatctctacaaaatattacagataaaaaaattatccagtgtggtggcgcatgcttgtagtcccagctactcaggaggctgaggcaggagaaccgcttgagcccaggaagcggaggttgcagtgagccaagatcacgccactgcactccagtctgggcaacagagggagattgtctcaaattaagagagagagagagaaagaatcaaagtctgtaagtaccgtttcgtgtcagagaggaggagagatggcagagcctttagggaagactgtgaagatgtactgttggccctgccaggttaaaagaaatgtggtctttgaagtgcaaatacataagcttttcaaacctgagcaataaaagaaagtgctctggtggtcttttctctggtgttactatttgacagggcagtagcaagctagacgcaggggctatgacgctttgcttcagtaaagtgactgcgtctgaaacagcagctgcaatcaattcacctgcggtcattcttgaagagccatccaccttctgccaagcaccaaatagacaaatagcatacaagagacatcacgactgcaaccttcaagttcaaggcactaatctctgctatttccctcagaatcgtgacattgggttcctttctctccattaggcaagggttgttctggcatctcactatcattgaatttacgccacagttgagttccagtttaaatcaaccaaccacataggctgttagagtcactttcagctgcatggaccaacattaaatataggccctctggtaaatgcccccagctcaagaaattgtgcccaatccaatgttatatccatcccttttggtagaacatccttagaattcacttccacacatattcgcccaggtttttgccaatatttcttaacgaaaatcatgttattgttctggtgtataggttttcctcttgtgttttagtgtgtacctgtccacctgtggtggattgcaccctcattatgggacagggggtggttgtggtgggttctgagaggagaatgggtatcctcttgcaaggcaccagagggctaccaggtcagccctaaaaattctcttactccttgtacctgcagggctaacagtgctaaatcaaacacaaactttaattgcttgggttacagaatcgcaacgtcagttgattcccagcctcgccacgtgtctcacatgaaatgtcaggcagtggtcgggaggagtgagaccctgaaacttaccattgctttcaagctcaaggacgcaaacaaaccaatctccaaaccccatctttcaggatatgattcttgacaccactccagctgccaattttgctatcagccaggatctgatcaggaagtagaaaggatgacagctcctcccttggtgcatgcagttgagatttcaagtgatcttcctgccttggcctcctgagtagctgggactacaggcatgtgccaccacaccaggctacgttttgtattttttgtagacgaatgtctcgaactcctgggctcaagtgatcctcccagctcagcctcccaaagtgcaggcactgcaggtgtgagtcacagcacccagcctcctctgtttgaagagtcctaactcccttcgttccccagcctgaggggctgtgttaatttcctggagctgccatagcaaagtgccacaaaccaagtggcttcgacagcagaaatggattctctcacagttctgcagggaagaagcccgagatcaaggctgtgagagagcaggaggatcacttgagcctgggagtttgaggttgcagtgaaccatgactgtcccactgcactccagtctgggcaacagaggagattctgtcgaaagaaagagagagagagagagagagaaaaaggaaggtaggaaagaaggaaggaaggaagggagggagggagggagggagggaggggaaagaaataagaaaagaagagagagagaaagagaaaggaaggaaggagagagagaaagaaaggaaggaagaaaagataagaaagaaaaaggaaaggaaagaaagaaggaaggaagaaaagaaagaaagagagaaagagaaaaggaaggagagagagaaaggaagaagaaaagagaaagaaagaagaaaaaagaaagaagaaagaaaacagaaagaaagaaaaagaaagaaagagaaagaaagaagaaaaggaaggaagggaagaaaggaaggaaggaaggaacaaaggaaggggaagaaagggagggaaggaaggaaggaaggaagttggttagagagaggcccacagagctgaagctgggtctctgaggtctgaggtgggggcgtggcctagctagttgtggaggagtgagctcagtagagggacttgtggggctgggatccagacctctaaggagcaggggtctggctgatgctggggtctctgagctcaggggatggcctagtactcagattttggagcatagggcactgggtgtccggtggtggtgtctcagaggtgggatgcaatgaagctggtcttgcaagtgttgagagatctgaaaattggcttcaggcagtgccacggaaatgaagcacttgctgcaagggtgaagaagccttgttagatggtgcgcccaggaaggagcaggtcccttcttcctcctccagtcttgtgggctcccttaaacgcccccagctagcagagcctaggagggaggcgctggtaaagcaggagcatcaccaagcagaggacagcaaagggggtggcacgcccactccacaagccagcactgctccttctagggcacggatctcagagaaaggactgcatatgcccactttatccatgatggctaccattggaaacaacccacacgtccatcaacgggggaatgggtaagtgagtcgcggtgcatgcgtgcatacaatggctactagtcagcatcacagagggaagaagggacacagacgtcaacctggatgagtctcatggaagtgattccagaaagaagccggcacaaagggctccagagcgtgtgcttccatttccatacccgtcaggagcaggcgagaccatctacagccatagacggcaggacagggcttagatctgcagccagggattggctgcctggaggcacaaaagcattctctgtggtgatgcaaatgttctttagttggtccaagttgtggctgcatgtgtggataggcaggtgaaaaaaccaggcgtgcacttgattttctgcacagtaatcctcaataaggacttgtttcacggatttttagggcagtggagttactctgtatgatactgtaagggtggatccatgtcattatacctttgtccaaacccataaatggacaacaccagagtgaaccccgatgtcagctatgggctttagttcatgcgagcttctcactgtggctcaccaattgtaacaaacgtactacactgactcgaaatgttcatcatggggaggcgtaaggggagtgacggggtctgtgggaactccttactttccgctcaatttttctgcaaacctaaaattgctctaaaaagcaaaatgccttaattttttaaaaacccaggaaagcagcccagggccgatgtggcagctccaggtgctcaggccctcgggctgcctttgttgctgttccgccatcctcaacgtgcgacttccctttggtgcgacaaggtagctctccccatgatcacagatcacatttgcctttcagctgtaaggagacagaaagtggctggcacaaggccatgcgtggtggctcacgcctgtaatcccagcagtctcggatgccaaggcgggcagatcacctgagatcagtagttcgagaccagcctggccaacgtggcaaaaccctgtctctactaaaaatacaaaaataagctgggtgtggtggcgggcgcctgtggtcccagctactctggaggctgaggcaggagaatcacttgaacctgggaggcagagggtgccgtgagccaagatcatgccactgcactctagcctgggtgatcgagcgagactccatctcaaaaaagaaaaaaagaaagaaagaaagaaaggaaggaaggaaggaaggaaggaaggaaggaaggaagggaaggaaggaaggaagggaaggaaggaaggaagaaaggcgccagcacaggtttgccctgcaggtatgggtgcactcatgccccaccaccctactgggtgcatagaggctgggaaatgggtcttcagctgagctgccatgtccccaagccacaaatctagtgttatggaagaacagaaaaacagatattggagggcaataagtggacgctgttacaggtggggatcaagggggacaatgagtgtagaggagtcttgaggggttttgctgtaaacaggagcagtgaaacggggcaagagccagggggcatgcggaggcaggagcgggagcttccggtgatagaagctccaagggcatgttggtatgctgctgggcctgaccccacagggagagagaaaaattacaggtgcagaaaacaggaggagagagggggtctcaggggtggcagagaccactgcacatggtgggaagtgttcacctgagggggctagggctggggaggggacagatttgatgatgggaactcaaggaaagaaattctcgtcagatgctctcaacttgctcagtgaaacatgaaacaaagttctcaccttgaaagtgcagggcctgggggctgaggggaaggtgtgaggccttggagaaccagggaggaaactctagaattcccaaggaaggctggctctgcctgggtccacttgaggcttgtggtcataaatctaaggtgcttagtcctgggctgggtgtggtggctcacgcctgtaatgccagcactatcgggaggccgaggtgggagaattgcttgagcccaggagttcgaaaccagcctgagcaacatagggagactccatctctacaacaataatttaaagattagccaggcgtggtggcgtgctccagtggtcctagctacttgagaggctgaagccagaggatttcttgagcccgggaagtggagggctcacctgtgctgggttttctttctttctttctttctttctttctttctttctttctttctttctttctttctttcttttttctttctttctttctctttctttccttttctttctctccctccctcccttcctttctttctttcttgcttgctttcttgctttgtctttctctttctttcttctttctttctttctctttccctccctccctccctctctctctctgtctctctctctctttctttctttctctctttccctccctccctccctccctctctctctctctctctctctctctctctctctttctttctttctttctttttctttctttgtctcgctctgtcgcccaggctggagtgcactggtacaatctcaggtcgctgcaacctgatttttttacctgcctatccacacatgcaaccacgactcggaccaaactaaagaacatttgcatcaccacagagaatgcctttgtgcttccaggcaaccaatccccagctacagaggtaagccctgtcctgccatctatggctgtagatggtctcacctgctcctgatcacgccactgcacttcagcctgggagacagagtgagaccctgtctcaaaaaataaataaataaggtgctttgtactggtttagagggctgggtaccccagagagaacgatgccaccggggcacatcatgagtcttccactgagccatggagctgtgtcccttgagacaggggaagaggctcctgccgctggccacactctactctcatgtttgagcagtgaagggcccggccatggtgacagctaagcttggtctcaggaggccagcagaggcgaggatcctgagccccagcaacaatgtgacagcaacacccaaggcagccaacagccaggcctggcagggtgggtggaaggcccgggctctgggaaggggcagggaagcatcaggactgtgtggctgggccacacccgggcccgcctggcaggtcgctcctagcacctcccacagtgtgacgtggacaggggaagtaagtgttccgcgaaataacaaaaggtgctcttgattttcaggttttatttgcctgttataattctgatattatgtacatatatatatatacttttgtttttttgtagagggcttatcagtagaccaagcacaggcatacagggaggctgtggctgctgagcagtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggtgggggcgggaggaggctgaggaagacaactgttcagacgatagggagggcagggctgctaaggggtcctggggggtgggggcggctggaagaggccggccagtgggcagtgggaggaggtgtgcccgccccgcagccaggtagtgacggaggccacttggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatctcgtagtcagtgtcaggctgcaggtcccactgcgtgtaggagctctggttgtagctgacatactgtggcgaaagggaagccccacccttctcttctgccagggagagagggtggcagcaggggtgagtcggagtgccaggcaacccctctggcccagagcccccttccccaccacgccccaaggccccctttcacgcttacctcccaaggctttgaacaagatatggaacctgaagttgcactggccctccttggggacccaggagacgacactgtagttttcacccgctgtggctgagatgttgccaaaatctgagatccctggggggatgcaggggaacgaggagagtgtggcagctgccaggaagtctaaggccctccctcctggacccggctggccggggcctccctgttggcaggtcattcctccagcttaccagacaaggccatagtgcctccttcccgtacgatggcttcaccagggccctctttggtggtggcctgaagctggaagcggtaccgcaggtgggggctgagatcggtcaggttgtgtgtccgaagttcggggtcccgaaggttgaaggacagttgccccttgcccccctcatccactgtggggacagacaggggttggctgtggctgcagctctgccccctccccgtggcccctccacctcccttccctgctggggcggcgcacgcacgggggtggtaggagagcacgtagccggtgagcacgccgttgtggctgagtgggggctgccagcgcagcagcaggctggtgttcgactggcactccaggtgcaacgcctcggggtggccaggcactgcagggcacagaaccgagtggcaggtaggtcctcgcccaggtctggggaggagggcaggggatgaggcgtggggtgcaggactcacctccctctggggtgctgaaggtgaactcgctggcgggccccgatcctcgcccgttaaaggcctgcacctccaggtggtaggagctatagggccgcaagccactgaggatgacactggtggtgttggcgggcaccaccacatggtctttgtggatatgtctcttgctgtgcttcctctgactgccctccctccagtacgtcacctgcacaagcgaacaggagacctcgcaggggcagaaggcacccagcagggcccccagcgcacacccccaccacccttaatggggaccctcctctcaacccaagtcttccaggagagcggctggcaggtggcaaagccccctcaccatcctgtcgctttacctcagtgatcaccctcctgggcccccatgccttcaacccttacattgtatccgcggaggtggcccttgacctgggccaggtccaccggccgccacttgaccagcacggcacttgagttgaggatttcaatgccttccagctcagggattgcctgggggtctggaaaccaccagtgacttggatagagccataggctctcaccccagccctgaggccaggcccaagcccctacacacagagaagacgaattcggatattttatgaggtacagtttgaggaggagaggtgtgtttgcatggtctcaagatctcttcctggactgcttattagttgcaaaggtgaaaatagtagcttatacaaaggagaaaccatggctgggcgtgatggttcacacccgtattcccaacactttgggagacagaggcgagtggaacatttgaggtctggagttcgagaccaacctgatcaacatggtgcaaccgcatctctactaaatacgaaaattagttgggtgtggtggcgcgtgcctgtaatcccagctaatcaggaggctgaggcaggagaatcgcttgaacccgggaggcagaggttgcagtgagccaagaccgctccactgcactccagcctggatgacagagcaagactccatctcaaaaaaaaaaaaaaagaaagaaaagaaaagaaaagaaaaaagaaaagaaaaaaaggagaaaccagaaaaaaaacttgaccgggtacttcaagttaccatctggtcatgttccagattcaaggaaatgaaagaagcagcattggctgatataactggaataccgctgccaattatagaaatgtgaagtgtggggaatttcataacgtcgctctggttatgtaagagaatatcctcatccttaggaaaggcgcacaccaatgctgagaggtgtggacatgggctggggtggaagcaggcgagctcaaccgtgggcgaggggccctgccggatactcacagtcctctccagagtagccgatagtgacctggggctctggtcccttgccctggctgttgacggcctggactttgatctcatagggcacgaaggtggacgtgttggacaccaccaggaaggggtcgctgacaatctgctcctgccagggccctcgtgtcccctgagggcgccactgcacgcggtactgaacctggggggcgttccagtccatccaccggagcggctggaggaggccagcagaagaggagttggttggccaagaacaccagcattctttggcccgccccccagcacaaaccagcatccccagacatcagccccttcctttgcatagccaagggggagcaacagacacccaggtcatggcctcatgtcccccaggcagctcagcccagggactctcaccttccacgtgatgaccatattggtggtctcatttccttcccccttcacatccacagggttcttctctggggctggaaaggaaagtattaacacatcaatgctgcagcctcttttggagagccacgaggaccgagggccaaggaacaaatggctcattctggcaccaagggagtccagccccctcgcgctccccctggaaatttggaagcagaggaacttgggcatggcacctctctaagccctcccttcacagcccggagcccttccaggtggcatgggagtgggtgccaccctgactcacctgcctcaggtgtgaccacagtctcagagaccgggctgggctccccggggccatatttgtttatggcagtaaccctaaaggtgtagtggacatagggcgacagcttgagggtggtagaggtctggttccctggaaccttgcccagactgtaccatttttcaggcgccatttccttgtcctcaaattcaatgtcatattctgccaagaaatgaaccgacaatggagtgatcagcatgtggctttgggggaagggctgtggaggggttgggtacagtctgggtccctgattacccaggccaactggcatctccagattcccatgaggaaccgtgagtccccccaaaccgtgtccccccaggaaggctccaggaggagggaggaccccaggaggggccagggctggcagaagtgacggtggggtggcactgagctcaagcctcttactctcaatgggggcattgtggtcttctgcaggactccaggacacgcgcacctggctctgcgtcagcaggtgcaggtcggacagcaccagccgtggcaccggcccagggctccctgagggtggggagggtcggtgcttgaaagggcccagggatgtgagccccggccttctggagtggaggcttccaccctaggacttacccaccaccaagagctgtgccctactctccaccacatccagttcggtactggccacgcagctgtagttgccctggtcgctgtagtccaggctgtggatgaccaggcgcccatcctctatgaagtacctgcggaggagccgtgtctgtctttcctgccatctgggctcttctcccctcccatccctccctcctgtctccttcccccgctcctgtcagagccttccccatcaaagcaaggacgaggccaagaggtctggacttccagcttttcccactctgccccctttcaccgtcactgtcctcacttgtcactgtccccaagctcctggaggtctcgaccgtccccacgccaggtgatgctgggctgcaaggaggggtcaaaggaggcctggcacgtgaaggtcaccctggaacctttcttctcgattgtgctgcggggcccctgagtgatctgagttgcatctgagggtaatgcgtgcgtggggaagtcactctgttgtcctccagaggcccagaccctccctcccagaggcactgccagccatgtggcaagggttgcctgacctttaaccttcaggttagccatgatggtaacattgttttggtcattggcagccaggcagaagtagcgtccggtgtcattggcctggaggtctcgaatgcccagggtcccattggcataggggaagaagcgttcgtcctgaagcactgttgtcccatcctcgtccagcctggagggagcagggcgggcctggctctgactggctggcctgggctccctgccctccctggctccctggccactgggacacgacactcaccactaccaggacgagacactcaccactgaacactgggcacaggcgctccgaaggccttgcacagaaggtaggcagtgctgccctggacagccatgtacgtctgattgtccgcagtcaggatcttggctggcagctctaggggaggaacagcctcaggagacagggcaggacttgggaccacagctgggccaggagccagggaccctctgcacggcttcctcgggcccccaagagccctgcaaatcttggttccctgctcccagctgaggcccccgccaggctgtgtctctctctgccttcagacactgccctctgcctcagatgcgcctctggtcacagccacccaacttttacgttattccaggcctaactgacagtcacctctccccagaagccttcctggcctagtccccagccttccctgaagttccaggagaggtgccacctgggctggccttggtcacatcctgtggcacagcggtccgctcagtcacagtgacaagacctttcccctcttacatctccctcggctatcgtgaggctgagtgagatggggcgaagggtgtcagcaaggagaaaggtcggcgccagcctggtaggccgaggacacatcagctgccagctgagccactctggtggcctggcccagtgggctgcagggacagactgggagttaggaggtaaggaagggagggcactcacggacaacgtagatgtaggcattggccagcaagagcccgtgccggttgcgggcctcacattgggtcaccattgtgtcactgggctgcacgttgctcaggatcagggcgccacgctgaatccggtacttctggtctttggccagctctgtgcatgcagcaggtgggcccatgggccacagcccggcattgagctgcgttgaggcccttcctcaccctcctcttcctctcccccacagcccccagggctcgccacactccccactcctgcctgaggccctgctcaccctccacagggatcccgttgattctccaggtgacctctggttggggcctgccctggacttggcagtccaggcgggcagtctctcctggcccatatagatggctctggggcttgtgcagccagtacggggcagctgggaggaaggggagagccgccctgagcccgcagccagcagctggctcttgacccggcgcagaccctcccctcccccatgacagtgggcatcacaggccactgtcccaggaggtccataccctccacggtgacatagtacgcatgccgggcactgcccagtgagttctcggccaggcagcggtactcgccatcatcctcctcgcccactttcagcagctgcagggtcttgttgtggttctggtaggtgacacggtcggctggcatggggccactggggcgcagccatttgatggtgggcgtgggactgcccgggaggcaaagggaagagagcagaagggagaaaggacaaggccaatcaccccagccccctataccccgcggtggtctgagctccctgctagggctccgccaccctgccctgccctgccctgccctgggttcccagactcacaagccctcggcgatgcactccaggaccaatggctgcccctgcaaggccaccaggtggctgctggagttggtggggaagagcaggcgcggcttcctgtcaatcatgctgttggctgccaggagaaagtgggtgggtgggctgcccactcttccctccaccccagaattgcaaggctgagggactcgacactccagccagcccccggggcctctgtgtcttcctccattaaggagagtgtcctgtctctgctctcgacgcctgggaaggggtctgggcagggtagaggtgggagccaagctgttcttgaggaagcctggagttgtcagatggacctatggtgggaagggccatgcctgagggtgaaaggagtcagggagagagtgcagagcctctgagactcactggccttgacccggaggtcaatgggttccttctgaatgatggtcctggtgcctgggaagtgggcgtggcagatgtagtctgagtggttgtcggaggtgagcacattggcaaagtagaggttgccgttctggcccatcgtcacccgctcgtcctgcttgatgtgcaagatctctgcagggggcaaggaggccgaagtcatgaccccgtccaggaagacacccccgctaacaccccgaccccacgaggcagccgctcgccggcacccactgctgttcatccagtagatccggagaggctctgcacttgggggagggttgcaaggcagaaccactgactccccttcctccacctccacgggcttcactgtctcctttggccacttgggggcacctagaagggacagacgggctgacactctcctcctggtccagatggtgctaggcaggagaagggaggtgggggcaggggggtggcgggctacaccagggatggacgagggggcgagagggtcaggccagtagaaacttcacagaaaaggaggcagacactctggataccttctggactcatagcagagactagcacttagggaggccagggtgagcaggagaccaggaggccaggaagggttaaccttccacggttctcagctctccctgcccaccctaggaaaggacgggtggggggaggctgaggctgaggtgcagtgatgggggaggggagctgtggagggatgcaggagtcacagacccttccatcatcctgacacagaaaccatggcaacggttcccaaggtaactggaggggtggggaggggagaggagagcgctcaggaagcagaaagctcagggaggatggaatgcaaagggaaaaccccagggaaaaggcgacacagatcaagacagagccgtggagcaagagagaccaagtcggaggtggaggggaggagatggagagccaagtggaaaagccagagaagaggggccctgctaaggagtgcaggtgtagacagagatgactgcagtgactcaggcaggtctgcccagaatcagtcactccccccaccagcccgccccccccctccccccccgccaccttcctgctcagccatgaggcaggcaccaggaaagcctgagggagtgaaagggcatgagatgaccggaagtgcaatggagacagagacagggcaaaggaggagactgcacaagaaacaagatgggccaggggagaagctggggtggggtggagggctggcaggacacccaggcccctcgccacgagacaactggctgacagcagcttccagcccacaatcccacacgaactccgggacctgccctccctggtccctgcagcgcctcgcaccctcggccatgagccggatctcatgggacatggcggtgcccagcttattgctggcaaagcagcggtagatgccctggaacctctgagcaaagttgctgttgttgcccgtgatggtgaaggagccagagtggggcgactggtacacggtcacacccagctcttccttgggtttgaagtggacaccatccctcgtccagcggaacctgtgggcggaaaaaggcccagaggcctgaggccctggaacccaacgggggctggaacaggctggagggacaggtgcaagcagccagggcccccaggggatggactgggagatggcgaggacttggggtgattagcaaggtttggggcttctgggcttagaagttaggcagtccagggaggcacaaggccggggtcagtggcaggcaacaggggctgagacggcagagatcactcactgcacttcgggcttgccactggcctcacacttgaggctgatgtcatctgtggggaagacaaccaggcgccgtggagactgttccgtgatgacaggtggctccatcactgaagacagggtggagagagcggtggtgagggtgctgcctggctggtgtcatagcctcagcacctgtcccatcgtgagggaagcagggtccagagcccctggaggccccatggccacagggggacgaacggaggggaagaacaaaagaggcttgtgggacatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgtccttcatctgagaaatccaggcaggcagcaagggagggaatggagagaaatactgacaggcagccccagagtggggcagatggcaggggacatagtaagctcctgcagcccccccgtggagagggaatggcaggagaggaggccctggcagtggcaacaagggggcacacgctgggctggagcagtggcaggtcaagcccagggagatgggacagagagatgcccagggagaggagctccactggatagacacacagggcatgtagcccagaggcagccaggccatgcctccagctctagcagacagggagagagaaattcttgcctttaacaaggagtgtccttgcagccccctggcagggcctggcagggcctgcagaactgaccccacccattcaggatgccttggaaggcaccgtcccctgctccagcctgcttccctcctaatccaattagcacagctgagtgttttcaattaccagggcccagccttcagagccctgctgccccctccccctgaaaactatcccaaaggccctgctgcctctgagtttccatagcctgcggggttggcgccagccctcctcttctccctccttcctcccagacagccaccaagctctctggggcagaggccagagctgctgtcccagccccaggactctgcagagcactggccagggcggcctcgaggaagggagaagagggagggagggagcagcaggctgcctctgaaagctttgtctctgcagaagacctcagtgtgaaggtccagggagggaggagggggctccctggggacactgcagagggccctgagctggggagggagatggtgacagggatgacaggatgcagaaagccaactaggtggaggaagcaggaaaagagacaaagggggctggagtggctggggagggagagatggaagacaggttccaacagggagggccggctgcctgccactgcccactgtgtcgtatcagggtcaagaacaagtgctggtcagtgaccagggcagccttggagctgccatggccttttggcctagttctctctccccactcccatctttctgtagagaatgcacggcttgcattccactgtacagtgttatattgtgtatccacctctgtgtcctctgggtctaaaagcctcactggtgtgtgtttccacctgtgtggcctctcagcggctctgctccttcatccctgcacctgccttgtcttcatgcacctgtgtgcatgtgtccatgtgcatctgtaccaagggagtctgcctggccctggccctccatgtatgtgtctaaggggccagcccctttacctcctccaagccctcactgcctcccaacgccaggtgcctccccagcctctctctcgcagcccctgtcccactgctggcacagacagtcttcccaacccctatccgccaactcgtctctcagtgacactggcctcctccttgtccaggcccagagacaaaggtgtcaaggtgaggctgggaagggactggagcctggtagctcaagagacacaaatgccctcacacatgataccctgtgacatgcccctcacacggcctgacagctacttacaggagaaaacaccatcacggtaacaccccccacacgcaagtgtgtacttacattcagccccactcacacatacacatgacccaatgcaatcaaatgtcgtggtcaaatacctcccgacctccacaagcctggccagtaagtaacagagtgactcacacagtcacccatgtaaggaagtcaaaatcacattcacgaatatctacgctcagtcaatcacaagaacacacagacatacacagtgtatccatgcttaatcacaaccctacggccacactccccaacatccactcacctgcttgtgcccccaacaaatgttacaaccatagacacatgctccagcagccctgcccccacccccaccaaataactacacacaaaaaagggtccagaaggctgctgggctgggaccagggtttttcaagccaccttttcctgtctcagttcagagacagggtgaccaagggcccaggaggggaaagagaaatggggacaagacttgaacacaggcctttgcacaagccagctgagggctggggacgaccccattctcctgctgccacacccctgtggtgggggatggaagcggaggagtcggagtggggcgggcagagatggggcgggctaaggagagcatggaggaggcccaagacctcggggccctgctccaggttcgctgtccctggtgctgaaatcgccccggcggccgcgcctgtccctgtccatggtcctgacacgccccgcaccttctaccctgcccttctctccgggggtacccaacgtcctggctatctcctgcccaccctgtgcccaggaaaggccagggagaggagtcagggtccggaacagggagaaggtgaggaggtagaagataaagaggggcccaacatagcggcgaaggtaggcgcccaggctcccttcagctactcacattcctcggggatctggataagcaggcaggggctgcagaggaggagaggccacacgtaccgcagcgccacgaccatctttcccggcggcaccgcgcagcacagccagccgggctcggttcaggctccggccggaggggaagggggctggtgggcggcttggggcgggagttgggagtgggggcactgggagaggggagaagggaagggaagggtgggggaagagagacgagagaacggaaggacgttagtgactaacatctgggtaagcccgggctcttggccccgccctcagccccgcccccagctggccggcttctccagccctcccctccccatccgcacccctccccaccttggagggagaaatctggaagagatagccctggctgggcctctaggttgccttttattccctctctactctctgtctgcacctttcctgccagctgccttcccagcaccaacttgttgccccatcagctcccctgtgcatggcatgcacatccccgtatgtgtctgcatgtgcaggtgtccgtgggcatgtgtgtggttgtggatctgcaagcagggagtgagctgtatgtgagctggtatttctgtggtgtgtcttctctgggaggggttgcactcatgagtgggtgtgttagtgtgtgtgcctgagggaatcaacacacaagtctgctagctacgtgtgtcttcttgtatgtctttatgtatctgtggggatgaatccctgtatctattatctctgtgtgcacacacatgtagagaagaattcttcttgcagtcacattgctatagctttcagagccaactgatgcctgggtgctgtacagacctaaaaagctaatggggggattgggaagtgggatagagaagggaggaaaggggcccaagatggcagcatttcacaaaatagtttcaggaaaatgaagaaagaatggggaaagggccaggcgtggtggctcacgcctgtaatcccagtagtttgggaggctgaggtgggtggatctcttgaggttgggagtttgagaccagcctggccaacatggcggaaccccgtctctactaaaaatacaaaaagaaaaaaaattagccttggtggtgggcgcctgtaatgccagctacttgggaggctgaggcatgagaatcacttgagcctgagaggcggaggttgcagtgagccaagatcgtgccactgccccccagcctgggtgatggagtgagactctgtctaaaaaaataaataaaaataaaaataaaaggccaggcacagtggctcatgcctgtaatcccagcactttgggaggccgaggtgggtggatcacctgaagtcaggagttcaaaaccagccaggccaacatggtgaaaccctgtctctagtaaaaatacaaaattagggctgggcgtggtggctcacgcctgtaatcccagcactttgggaggctgaggcaggcggatcatgaggtcagcagtttgagaccagcctggccaacatggtgaaatcctgtctctactaaaaatacaaaaaaaaaaaaaaaaaaaaaaaaaaaagccaggcgtggtggctcatgcctgtaatcccagctactcaggaggctgaggcaggagaatcacttgaacccaggaggcagaggttgcggtgagcggagattgcgccattgtactccagcctgggtgacagagcaagactctgtctcaaaaaaaaaaaaaaagttagcctggcgtggtggtgcattcctgtaatcccagctacttgggaggctgaggcaggagaatctcttgaacccaggaggcggaagttgcagtgagccaagatcgcaccattgcactccagcctgggcaacaagagcgaaactccatctcaaaaaaaagagagaaagaatggggaaggaagccttcccttgagaactggtgtgggagaagagaggaaggaggaaaacaaccccctgctgctcctcagccccctgggggtcaagagaggccactgaggcctcctcccttccagatgctccaggttagggtcaggacaggggtcaggacaagctctgggacattttccgtgacagtgtttctaacacttcttgtgtgtctcaaagtcccaatttctaggtctttgtctgagtcttcagagctcaactgctgcatgtgtccaccccaaacccaagccacaccggccatgtccatattcacctacaagtaaggggagccaaagactaagggtctgaaagagggggctcctctgacaatgacaagaggaaacagactcccaagtggccagaccacttcaattccaaacaggaagtggttaaagtgcaggcaaggcaagaaagggtgttgttaggtgacagagcttggaggctgaagtcccagactagacgccttcattaaatccatactgtgcatcctccctctgcccagccaggaccttatcaaagcgggcaccgagcctcagcaggaacaccgaaaggatggtagagaagtcagccatgctgtgctaaggctctgggccttgtcagttttgtgtaacagagtgacccaagaagagctgtgaatgcggcagatcccgtggggactctgggcaagagcttgctgcagagggtggtggagaagcagcagggtgggtcagcgtgcatggcctggaggccaagagatgacttggagggtaagaagagtgattcccagcctgcaagagctggacctgggcccagaagggaagagcaacagtggatctgttccaccccggcctctccctacaaagccagtggatcaggggaggccccaggcagcactggcctcaacttcaaggcctgtaggagcagtaggagactcggatcagagagcagatgatcaaacagcagccttgggagctctgagcactggtcttaggagggggaggggaggaaaccggagcaaggaaaagctcaaagaaggaccctcctgcatgtcagaggcttttgggtgctctggaggtcgataatttctgccacgcaagttcctctatttgtcctccaaatctagaatcctggaatggtgtttggcatgtacgctcaggggaaatacaatatccccaaacccctggtccccgctccctgccccatcccagccccatcccatctccccacaggctcatatccaacttcttttttggtctcccagtatttgccacctagcttgccaccgccctgggcagtcggagacaggcaggaagcagccagaaggttgcgagatataacagctgggagggggcgctccctcctctcctcccactgctgctgggtctctgatctctcaccattcctcaggcaattacagagcaagcagctagggttgtcagctcagcaggccctctaccccccaccagcaccactaagggcaaaggagcggggaggggggagtgttccacagatggagccaaggccgggtctgccaagggtgacagacagagtgagaagaggcaggggggagcaggagacaaagacagacgtaggaagacagcgctaaccacgatggagatggttagggggtggggaaattccgaaacggagacccaggcagcagagaaagggagagaagaggaaaccggagcacaaagggtgagaggcagctgcagagtgcgccgctgagaaatggcagaaagagcgagaagagtgaggggtgggggtgggcgtgtgcacgtgcgcgtgcgcgcaggccgcctgcacagcgtccttgtccctgggggctgtgccaggcaaggggcggggaggagggaagatgggcctgggtcagtggaggggcttcccggcgtggacgtcacgctggcctgggagcagggtagagagacagacagagggtggagcagctgtgagctggggccggaggcctacaaagccccacgcaacagagcatcaagccctgcccacttgtggcactgggcaagggacggccgtgagacaggatgaatggcacactgctggctgacccatgccatgccagggaacaggtgggggtcgggggattcctgctgcgggtaggaacggggggagggggaagcacccagaaaatcccagggaagccttccaatattgctgctggctgggagtaagtggtcacctggctggaggagacgcacatgtgttaggccaagagtgagcctgcgtgaccatgcactgagtggacagtggccgctgtgctggggcagttgaagatggggccattcctgagtaagtccggtcccaaacccatcctccccggtgggaaagggccagggaggcaagggtcacgcccagcagcctacagggaggggttcagccccagaagagccttgccccatcccaccccacctggcctcccactacacccgcaggtccctcagggagtcctctgtcctctgctccaaagtgcctgctttggtctgatgggaagcagcttgccagggagggacctgggaggttgtggagcctggctagacctggagtgactgcctcctccctgaaaacacacacacacaccccatcaccaccaccaccacacaccttgagaagggaacctccagcggtgccctgcacatgtgccctgcacacctgcctgtcagttctcaggttctgcctggagttcctctcaaaggagaagcaacaagagagcccttcaacagcacagcagagactatccggcttctcctgcccttgtctcctggggacatggtgcctggtgactcagtgggccagagtgggggtggggctgggggctcagcacagggcacatgaaagggtcagagtgtggtgctgggcccatgtgcttgcaggcctgggagcctggggggcttctgtgcctgttggtgtgtatacgatggtgtgggtgtcacctacaccctgtgcactgtgtccctttaaggctcccgctggccctccccgccccgctccccaggccgtggctggcgggtttctatggtgatgcagcccaagtcccagaggtgggggaagccagaggaaagccttgttatgtgttatgtagacagcacataaagggggctgctccagggagcccccacaggtacctgggggcccagaagtcctttatgactgctgcttagtccctgcactcccaacctcacccctccctaagagggtacccttaggagagagtgagccctcagccccctcatctcgcctgaggcttcagtctccaaggcaactacaactcacctgtaatggaccattctccttaaaagatggggaaaagagacggaggttaaccctttgtggggttcagggaggacggtcttgactactggggaagggagggaggagccccactccatccccacaatcacatgcctctgtggtctgttctattaaatcaacttacagcgtggacttaccacgtaccagaaagcctcatgagcacttccactcacatccactcatctcctccccagatttgcctcagggagggaggtgctatcatcatccccattttacagatgaggacacggaggctcagaaaactggaaactgtgtccaagatcacagagctggcactgggtctcagcaggggtggggttttagagggcgtggtggctccctaagctgcctctcagaggctctggcatcccaacatgtgtgcctgctgggcttcccagggaaccaggggcctgggcgaggatggcctccaagccatcctgccccgtggggagggcttacttgccaggcagatggcaggcaaatgtcgggggcagggagtgacatcttgggatggaggccatgcggaagtaggatgtgatcaacatcacgtctcagcacagagctgaagcccgacaccaaacaaacccccaagtcccccatccaggtactcagtccaagagaaggccaactcctttcccttttgggcttggggacaggctggtttcttggtcccctcttctgctctctggaatctggacttgttctgatacctttcttgcaaccagaggctccagaacccctcccaaagaggcccctctccaatcagcatttagggacagcagtggccccattcttgtgtcgaaggagatactgatgcccagcaggcggcaaggcttcagcctccgagaaccctagaaggcgagagaaatgaggtggcagaaaactagggctcctctcaggccccaggcctcctcagggagctaggatgaccctagcactagagggggcttcagcggccaggccagaaggaacagactgcatccagttcctggggctgtggcctgaaaaggagagcagggaaggagcccagcctggggcagggagaggccctggcccacagcagtcctgggatacctagcctgtgttggtttgcggggggcggggtgggggtgcctggaaacagctcagacactgccaggccccacgggccccctccaggggccccactcccgaggggttaaagggcagagggggacacaggaagcccgggggcggacaatggggcctctgtgatccccagggcttgggcattcctaagtcatgaacacagacgcagatggctgggagacagggccacagggaacccccctccactgaagcacagcctgggttggccagaggctctgtccccatccagccactgcagcagccaccctcagccccaccccttcccagcacaggccctgttggggcatctgaggagacccacgtggcctcatgacaatatgtgtgtgcatgctggttcacgaacacacacacacatgcaaccaaatatatgaccccacccagacaaacaggaatactggaggttacacacacacaaatacacacacacaagcagagacacaaaccccatacatgcagataggaagtctgcctggctggagggcagggggcagaggggctcccgggactcagtccctttccctcaagttccactctcagacccgcactgggatggacgggttcagaagtcctctttggccaagtgcatggagcccaggacgctgccaccctcctgccccacccaacccctggccctcgcagctgcccctgctgggtgtaagggccagagatgagcaggagctgctgactgacagtggctgggcactccctctgcagctttccaacctgggaagaacacggggacctgggctgggggccactggacaaagaaaagcttctagaaagaacagcggccagaccctccccagctcctccctctttttccagccacagccttcaggaagccacaaagaccctgttgatatctggggaagaggcaagctgggcgggctacctcccccagtgctcgtctggctgctgctcaccaggcaccccccatacagccttccactcagacaaggcccccatggggggtctgggcccaaccccaaggcgtagagtccagcagaagggtgctgagtggctgctggacagggcacaacctcagggccctcaagggtgaggcaggggcagctgggggggacaaggagaggagcagagcggtggaagacagacaaaagggtaagcagagagatggagcagagccctgacgggaagggggaagagggaagggagggccaggcaggcagaggcagagggaggagacggggagtggtgcaccccatccccggcagcagcaggcttctgcctagaaggaggaggaaggtgatggccctgggggtggggcacagggagacgtgggaggctgcagaggagagagcaggggggcgggggaagcaggagaaggaggtgtccgagatgggccagatcagagcaagtaagacagcgactgcaggggcagggatgctgcaggcccattccagatggccccacccagggacccagccccagcccattgcaggggcagaggacagggcaatgagcaccctgctggggaccctagaagggcatccagaccccccgcctcccccactgtctgaaccacgggggagggaggcagggcccccactcatgcccccactcatgcctggcagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtagggcacacaggcctgtctcctcgaccctcacctgccagtcctggccaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctgggtagggaagctcttcactggctgcagggcaggggaccccgccaccttgaagcgctgattgtcctcctgatgctcagcagggagctggcagctgggaacttggggaggagccttttaggagcgcggtgtagcaaaccagggaggctggggcgtgctgaacgtgtttccctcttggtgatcagatcactagcgattcttaatttcttttgttcttttctgtatatttcaagtgtcctacaataagatgtattactttcgggatcatacacacacaaacatcaataaatatggagagagactcagatgcagcagagagaaatgaccaggagccaaggaggtgggaaggtcccaggcccaaccctgccccaaacttcccatgtggccaagacagccgagtcctcaaaggctctggagccctcaggtgtgcacatgtgggcactgcatgggagctgtgccaggggagaggccaggctgggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcagggtacccctcacctgtagggctcgggcacccggcatccctcccccgccccgcttacagcccgcggtgcccggagcccgacgcccggcatgggtggggctccggcagcaacgccggttaccgcgggccggaccgggccgggcggactccctggtccgtgcaccccgggcagagcggggtggggtcgccgggggatcgcggccgcggcccgggtcgcacggggaggccagcccgccttacctgcgctgcggacaccgctcgggctgcccgcccagcctccgcgcacgccggcctcggacccgccgcccgagcgcgtctgcgatgccgatgctgcggcagcagcggctgtggcggggcggggcgggcgtgcgcgcaggggcgggggaggggagcgccggggaggagagggagggaggagtgagatcacctccccggccgcccgccccgccccgccccgccccgccgcaccctagcccctggtgccagccgagcgcggcttgggctgggggcccccgggcagcccactccgggagctcagcgggaccccagccgacgggtcccgccagacccccttccccgcagaccgggagtctccggccggagagtgtcctcagccccagcgcaagggagcccgctgtgaaagctcggagcgggaatcgcggggcgagagtgctcccagaggcctggggccgggcggtggagagaggagtccggcaaggaaggggatgctcccttagcctcggcctggccctcgacggcgccggccagcgatgggcacctgcacgcaacgcccccccaacacacacacacagggcaggactcccgggacctctcccgaatgccccccgatcctgagggcccagtcagggtcctgttgggaggggtgcgggggcttcgtcctcagcgtgttggggaggcgccgcggagcaccggctcctgcgcaccccagagcccaggtgggcggcagggtaggaggcgagcccaggggagacagggtctgggagagggtatccctcgaactgccacccccaactcccagattttcctccagctctctggtgtcttatttctttgtcctcgggattggccccattcgacctttcccgccgactccactctctcccactctcccccgcagccctgcacaggatcgagaaggaaggagctcctccccagtgccccctcctaggctcaaggccatgacctcacaggcgaggaagcaaaatggagggggtaagaattccggagccggcgagctggctgcagcctcagggctaggaaggcctagggccccgatggcagattgcagatctggcggccacggtatttttatgggcatgcctgttgcccagtgaagcattccaggggccctcgactcagtctcacaagactccccaagtggtgtggggccctggagggcccacatgggagcagccctggcatcctggcttggatgccccacccccatagtgccagcttcagttcccctggaatgggaagcttggggtggacccatctgtgctcagagagggtctggatgccatgtttgcccagcctttaggaggagaatggacaagactaggcacctgagtgaagacggacggctagggagactgcttccagagtgggggcacttgcagggcatcttcaggtgacagcagaggaaactgagcccgcctgggtcacgaggccagcaggctcatgagctgggccaagagggcgtactttccatgaggcactgagctgtggtcagcttcctgcctttgctgatctgaactctgataggcctctctcctttccagttgctgcctccactcactccctacgttcccagcctttcctccaagccccaacttctgcaaatcctttacctaatctagggtttgatgcccatcaggatggtgaagtaagcagggaatagagcccgtttatacgcacctgctaatgtgtagtgatgggtccatttatggtaacaaaaaattcattactaggattacacgacatcacatttcctgagcacagccatggacctgccatcgttacatttcctgcacatttaaattgcacaccaacctggggaggtctgttgaagcattcgccccacgttacagatgagaaaaccaaagcccacagagctcaaggctgggtccagcaagcacagttaggaaggtctctttctctccactggctcattgcatccacacacacaccccagatgatggtgctgttattatcctcactctcccagtgaggtacccaaggtccagagaggggcagtcatgcaaccaggaagaaattggcactatcagtgcccccatttcacagatgaggaaaccaaggttcagaggggtcaaatgacccacccaagatagcccagaaggtaaatggcagaactcggacttgaattcccttctgcttgaccacgatgcccattctcacttccatgtaatgaagtggaggagccaatgggagcaagagcaagagtgacagaagaccaagggcagagcaagtcccaggagaagcaggagggactggccctgaacaagaggcaagccacccccccactgccatgtgcttgctgttggaggttagggggacaccaagtagacagatgactgtctctttcccttcaacgtcaagtgcttctcacagccctgctccctgtgacccagccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctcaaaaaaaaaaaaaaaaaaatcaactttattggagtataatttacatacagtaaaattcatccttttgaggtttacagttcaaggagttttggtgaatgttgtgtgcagccaaccactcccaccaccccctgcccttggccaccactgatctgatttctgtcttttctaaattttattataaatggaatcataccgtatatattcttttgtctggcttctttcacactcacgcagcatactttttgagcttcatccatgttggtgtgtgtgtttgtgtgtgtgtgtgagagagagagagagagagcatgcgggcgagagagagcagtatatttccttttgattgccgagtagtattccattgtttggttggatcagggtttgttcagccattcactcactgaaggacacttgggtagtttccagctttgtgtgattatgatggagcagctctaaacatttatatgcaagcttgtgtaaatgtgtgtcttcatttctctaaggtaaccgcttaggagtggattgttcagtcaagtggtagattgatgttgaacctgcctttgtctttgaactgtgcaggtcagctggtcacacggtgatgactgctgctatctctggatgtagtcacgccaggtgagtatttgctttctatttgtcctgctttccccatctctctcccccacctccactttattattttttattagtgttgttattactttgagacagggtctcactctgttccctaggctggagtgcagtggtgtgatcatggctcactgcaacctcgacctcctgggctcaagtgatcctcccaccacagcctcccaagtactgggacaacagatgtgccaccaccacacttgattaatttttttttcttttttggtagaggtgaggtctcactatgttgtccagactggtcttgaactcctgggctcaagtggtgatccactgccttggcctcacaaagtgctaggattacaggagtgagtcactgcacctggcctcacccccacattgtatcagtgaaggtgtgtctggagttggttccttccagtgggttcttggtctcgctgacttcaagaatgaagccgcggaccttcgcggtgagtgttacagctcttaaaggtggcacagacccaaagtgtgagcagcagcaagatgtattgtgaagagtgaaagaacaaagcttccacagcatggaagaggacccaagcaggttgccgttgcttgtggggggcgggggggggccagcttttattcccttatttgtcccctcccatgtcctgctgattagtccattttacagagtgctgattggtccattttacagagtgctgattggtccatttacaatcctctagctagacacagaaaactggtgcgtttttacagactgctgattggtgcatttacaatcctttagctagacacagagcgctgattggtgtgtttacaatcctctagctagacagaaaagttctccaagtccccacatcacccaggaagtctagctggcttcacctctcaaaggttcagggtaggaagcagaaattcctcccgtgatcatgaacagaaagggattctgtagaagggattagatgcttacctgaccattggatgggccaaaggagtggactctgggctaggtgttgataacaccagtgcagacctggctcctcaagggagctgctacctctgccaccatccacaagatgggggattgggaggcggccagtgtaacctttgagttcaaaaagacaccaccaaagtcatgacctgaggatcagcaagctgggaccaggaagccattgctgccacaagtgcccctcaacaaccaagaagtgaaggttagaccccagaaattctttgatgtccagcagaaacgcagccccacacagcagaagtgtggcttcccttccttcagtcatccaaacttcatgtgagcacacccaatttggcaattggcaaatttgccaatttgccaattggcaaaactaaatttgcttcccaaagtccagctgctctggagtctggaacatttccagcctctgccatgcagagcccacaaggtgggagtgagtgccgagagctgtcaatatgcccaggcagatgctctgctcttggtcatcttttagatggactggatttgttctctcattctattttctcctctgtttgtttagaagtgctctatgaattttttagtagttcctctacctattttaacatgcattcttaataaagtctaaagttaactaatacctctgctctggtggttttaatgtaggtccataaattatttgatactcctgccttcaaaaggtagtgcttaattctcctcctcttgagtataggctggacttggtggctcacttttttttttttttttttgagatggagtttcgctcctgttgcccaggctggagtgcaatggtgtgatcccagcttgctgcaacctccacctcctgggttcaagcaattctcctgcctcagcctcccaagtagctgggattgcaggcgtgggccaccacgcccaactaatttttgtatttttagtagagatggggtttcaccatgttggtcagtctggtctcgaactcctgacctcaagtgatccacctacctcggcctcccaaagtgctgggattacaggtgtgtgagccaccacttttttttttttttttttgagatggagtttcactctgttgcccaggctggcatgcagtggcgtgatctcggctcactgcaacctccacctcctgggttcaagcgattctcctgcctcagccccccaagtagctgagattacaagcccccaccagcacgcccagctaatttttgtatttttagtagatacgaggtttcatcacgttggccaggctggtctcgaactcctgacctcaggtgatccgcccgcctcagcctcacaaagtgctggaatttcaggcttgagccactgtgcccggcctcatttcttttttaaattttattttagaagttgaggtcctgctctgtcactcaggctggagtgctgtggcatgttcatagctcattgcggcctcgaacttctgggctcaagtgatcctcccgcctcagcctcctcaggagctgggaccacaggcacacaccaccacacctggctcacttctgatgaaaagaataaagcggaagcaatggctgcagctgtggggactaggtcacacaggcactgctgcttcctccttgttttctctctctctctctctctctctctctctcggattgctctgttgggtgaagccaggtgccacatcgtgaggacactcaacagccctatggaggagctcacatggagagaaacaaaggtcttccgccaacaaccatgagtgtgccattttgaaaaggatcctccagccccagccaagcctttgcatgactgcagtcatggccagaatcccactgcagcctcacaagagcctttgagctagaacaatccagctaagccactcctgaatcctgacccacagagattatgagataataaatggttactgtcattttgaactactgcatttgggggtgatttggtttgcagccacagatcactaatacatcttccctcctcctacacaatgcacggcctgggataacatactagccacatgaggtgggccctattatcatgtaggaatgaggaaggcagtgagctcagatatgtggacaggaacccaggcagagtcagccgtctgagctttgggaagcctggttttcagtagctctagggacttacccacacccccacactcccacccctgaactgctattatggtgctgtagcccccacggtgcctgtcactacccaccagctgctgtcccctctcctctgtgtccatcttttcttcatgtctttgcttctcctggcattctcctgctttgtgacaaatacccgtggctttttctgcacatgtcttttggcttctaatctcactgcagtttcaattccaagagagagaaacttatgggcccaaatactcattatcctcattttggtggagccttcatgccaggtaacttcgtaggcaactaaccagcctatggactagctagtcttggccaggtgcgggctcctggtccaggcagctgaggccaaggttggttcaagctgtgtgataggcagtatggccatctgttatggacttaatgtgtgtgtacccccaaaattcgcacgttgaagtcctaacccccagatggagcagataaagaagaacagagaggctggacatgatggctcatgcctataatcccagcactttgggagaccaaggtgggcagatcacctgagtccaggagtttgagactagcctgggccacatggtgaaaccccatctctacaaaaaatacaaaaaattagccaggcatagtgacacacgcctgtagtccgttactcgggaggctgaggtgggagaatcacttgagccttggtggggaggctgtagtgagccgagattgcaccactgcactccaacctgggtgacagagtaagaccctgcctcaaaagaaaagaaagaaagagagagaaggaaagaagaaagaaagaaagaaagaaagaaagaaagaaagaaagaaagagaaagaaggaaagaaagaaagagaaagaaagaaagaaagaaagagaaagaaaagaaagagagaaagaaaaagaacacaagaaaagcactgttccctcccctccaccactgcccctaccatgtgaggacacagtgagaaggtggctgtctctaaaccaggaagacagccctcaccagaagtggaccctgccagaccttgatctgggacttccaacctccagaattgtgagaagataaatttccattgtttaagccacccagtctgtggtattttgtgatggcagctggagctgactaagacaccaccaatgggtaagtcactggctagtggtgctgctgcagcagggagtatgtcttggtgggcatcttgctcgacctctcctatctaaccacactgaagtcatgcattcccttgtttttctttatactaggcccacgaaaccccatgctttgaaaagaattgcttgtttgccttcaccactcctcctcacagcctggaggtgatcatgttactgtgtagactggtatccctagggacttatgggctccaaacaagctgcccatgaatatcacaatcctgtcacatgcccttagccagccctgcttcccttccacgcagtgcaccggctgggtgcagtggctgatgcctgtaatcccagcaccttgggagaccaaggcgggcgggtcacttgaggtcaggagttcgagaccagcctgtccaacaaggtgaaaccctgtctctactaaaagtttaaaaaaaaaaaaattagccgggcatgatggggcacctgtaatcccagctactcgggagactgaggcaggaaaaccagttgaacccaggaggcggaggttgcagtgagccgagatcatgccactacactgcatcctgggcaacagagcaagactccatcagaaagaaagaaagaaaagaaagaaaaggaaggaaggaagaaaggagaaagtgacagattaagcacatacattcactttctcttcctcatgaaatcccaccaaaatgacagtaaatgactttttaaaaagaaaaactcccaaggacagaaataatgggaaaatagaaaacagcagcaaaatcatgggagctgaatttcactgcggaacccacacgcatccagaaaatgggggtgagtatggaagtgccattaaaagtctgttgaagaggcagtcagatctccacatgcttttccccatcccaacggaacagaatgtttattctttggagatgatgaaacaaagagtgtttcaagtggggagtaccaggaacagcttagatggcaccatactaaaaatgagggggttaaataaatatttacctactgaatttggaccactttggaccctcctggcccactctgtttctcaagtgctgacaaccagcctcaggcagcaggctaaagatctatctctgggtatttggccatcccaaggtgaacgaaaaggtagtaaaattggggttctccaataaaaccagccccgctacatcatcctatgatgaagctcatagttgacatgtccttccttttcaatcagctcattagtgccccattctttttttttttttttttttgagacagagtttcgctcttgttgcccaggctggagtgcagtggcacaatctcggctcactgcaatctccacctcccggattcaagcgattctcctgcctcaggctcccaagtagctgggactacaggtgcgtaccaccatgcccagctaatttttgtatttttagtacaaacagggtttcaccatgttggccaggatggacttgatctcttgacctcaggtgatccgcccacttcggcctcccaaagtgttgggattacaggcatgagctgccatgcccagcctgccccattcttaaatatgagaagacaaccaaggatcaccagacacctgaggaaaacctttagcatgaaagcaggaaagatcaaaatcaaaacaaacaggaaaacaattgttgggaaacacgactatgagaggtaataatttttaaaactaggctgggcacggtggctcacgcctgtaatcccagcattttgggaggccgaggggggcagatcacaaggccaggagtttgagaccagcctgaccaacatggtgaaaccccgtctctaccaaaaaatacaaaaattagctgggcgtggtggcgcatgcctgtaatccaagctactcagaaagccgaggcaggagaattgcttgaacccaggaggcggggcttgcggtgagctgagattgtgccatggcactccagcctgggcgacagagcgagaatctgtctcataaaaaaatttttttaaaaagaatttttaaagctattaactcactcagggagataatagaatgtaaaaatatccatgaatcaagaataggatgctataaaaaaggaacattcagcgaacaaacaagagttttttgtggaagcatacatgaaaaattcaatagatggatatttttcttctaacaaaatacagaaagttgcaagacaacatcactcccatcctagctacaagaagctggataacctacaaatcataggattttttttcttttaaggctatcgggaagctgaggttggggggaaaaaaaatcaaaatcttgaaaagccctttctaggagaaaagagccccatagctgctttgatttttggcacagcagcagcaggaagaggaggctgccacagacttgtgtacaaaagaaacagagaaactctgaacacattttaaaaggctgagtgtgcgacggcatgaggctatagactctctaatgcctcccattcaagagagcttacattcacccactaactcttttgcatgggccttcaccaagaaagtttgaaggcaaagcaggtgggccgaaagatactctccgaggtagacatgtgctcaggctgctgaagtctggatgcaggacaagggaaccgacaggaacccccctggggctcctgaccttccactgagtacagagcagctgtaactggtgaatgaagcagggcaggaggactgaagagttcatccccaggctctaggaagtcttaaggcaggacagaagaactgaaacaaaccttccggttgattctaatccttacactgagtacaaaccagaagcgaactgtggttggagtggaggcaaaagacctacaataggcacccgggaatgtgcgctcagggatctgctgaagtctacgggtgaggcaggagaatcaaagaaactcccagccactcagatcacaagtcccaccaaagagaatgttctgatcctgctctgaaatcattcgaagtatacagaaaactgagtctacgcaaagcaacaagaaaccccagactccacttaactacacaccagcctctaatacacacacacgcatgcacacactaatggcctgacaagaagggtcatgccctttttggggcataattttatgtgtatcttccccactgttctattacatatatttaccccaggagggataaatatatatgattatttacttcttaaaatagaaataggccaggtgtggtggctcacacctgtaatcccagtactttgggaggctgaagtgggaggattgcttgagcccaggagtttgagaacagcctgggcaacatggaaagaccctgtctctataaaaatacaacaattagctgggtatggtggtacatgtctatagtcccagctactcaggaggctgagatgggaggatcccttgagcccgggaggtcgaggctgcagtgagccgtgatcatgccactgcactccagcctggctgacagagtgagaccctgccttaaaaaaaaaaaaaaaaaggaatttgggaagggctcacctgggcagtcctggcccaggtctttcatgtggtggctgtcagatggtggccctcttcatattgcctcagagccttttttttttttttttttttgagaaggtgtctcactttgttgcccaggctggagtgcagtggcggggtctcagctcactgcaacctccgcctcccgggttcaagccattctcctgcctcagcctcccgagtagctgggattacaggcgcacgccagcacacccagctaatttttgtgtttttcagtagagacagggtttcaccatgttggtcaggctggtctctatctcctgacctcttgatccacccacctcagcctcccaaagtgttgggattacacgtgtgagttactgtgcctggcctcagagccattttctgtggtccttccatgatggctgaattgggcttccttatagcatcagggaagttggaatgcttacatggtggctaaaggcttgaagagtgagtgtccctgttaacaaggcagaagctgcattaccttttctgcactagcctcagaaatcaatcagcaccacttttaccatattatcttgagtacaagaaagtcacaagcctgcccagattataggggggagggttaaattccacctcttgatggggaagtggcaaggttccaggagagcatgtgggatgggagatattgttggggctacctttgaaaaacacaatctgccacacacaccagttaaaaggcagagactgttgggctagataaaatagctatatgttatttacaagaagcacatttgaagcataaagacacagacatgttgagagtagaagtatggaaaaagatataccaagcaaccactgagcataagaaagctgccatggcatcatactaatatcaggtagagcagaattcaagacaaagagtttactagagatcaagagagacatgtcataatgaaaaaagaacacataatcaagaaaacacaaccatttcaaatatataagcacctaatctaccaaatatatgaaacaaaatttataggactaaagggttctagatacagataaatctccaaacatactggccaactttaacattcctttctcagtaaatgataaaacaaataggaaaaaaatcagaagaatatagatttgaacaacactatcaacctaattgactcaattgatatgtacggaacactacatccaacaacagcagaacacatattcttctcaagtgcagatggaaccccaaccaacacagacaacttctgggcaatcgagcaagcctcaataaattacaaagggtcaaaatcatacaaagtacgatttctgaccaaaatgatgttgaattagaaatcaacaacaaaaagacatctaggaattttctaaatattttgaaatgaaaaaatatctacttccaaataacccaagaaccaaagaagaaaccacaagtaaaattattggtagaacatatctttcactgaatagaaatgcaaataaaatatgaaaatttgggaattcaacaaaacaactgattagaggaaaaggaactacttatattagaaaagcagaaaggtcccaaaataattatttaaatttctactttaagaaactagagccggtcacggtggctcacacctgtaatcccagcactttgggaggccgaggcaggcagatcatgaggtcaagagatcgagatgatcctgaccaacatggtgaaaccccatctctactaaaaaatacaaaaattagctgggcgtggtggtgtgcacctgtaatcccagctactcaggaggctgaggcagaagaattgcttgaatctgggaggcagaagttgcagtgagccaagatcacaccactgcactccagcctgggcaacaagagcaaaacttcgtttcaaaacaaaacaaaacaaaaagatcaatgaaattgataagcctctagccagactgatcagaaaaaaaaaatggagagaagatacaaattaccaatatggagaataagagagagggggcattattacagatcctacaaacataaaaaagtgataagaggatgttgtgaaaaacttattccaatacatccaacaacttagatgaaatggacaaattccttgaaagatacaaatggtcaacgctcatttaggaaaaaatagataacctgattagccctgtatctgtcagaagagttgaatttataactgaaaaaattctcacaaagaaaactccaggtttgtgtaaataataccaattctatactaactcttccagaaaacagaaaaagagagaacacttcccaactcgttttataaagtcagcattatactcatccccaaaccaaagatattacagaaagggaaaacgtagaccagcatctctcattaatacagatgtaaaaatggtaaacaacagccaggcacagtggctcacacctgtcatcccagcactttgggaggccaaggtgggtggatcagaggtcaagagatcgagaccatcctggttaacatgatgaaaccctgtctctactaaaaacacaaaaattggccgggtgtggtggctcatgcctgtaatcccagcactttgggaggccgaggcaggtggatcacctgaggtcgggaattcgagaccagcctgaccaacatgaagaaaccccgtctctactaaaagtacaaaattagctgggcatggtggcgcttgcctgtaatcccagctacttgggaggctgaggcaagagaatctcttgaacctgggaggcgaaggttgcagtgagccaagatctcgccattgcactgcagcctgggcaacaagagtgaaactccgactcaaaaaaaaaaagaaaaaaaagaaaaaaattcaatactcacttgtgataaaagctttcagtataccgggtgacagagtgagagactatgcctcctccccaccaaaaaaaatataaaaaaaaaaaagaagttacacaaaatactatgtactcttttatttatttatttatttttattattatttttttttgagacggagtcttgctgtgtcacccaggctggagtgcaatggcaagatctcggctcactgaaacctccgcctcccgggttcaagcgattctccagcctcagcctctgagtagctgggattacaggcttgcgccaccacgcccggctaatttttgaaaatactacatactctatgattctatttatataaaattctagaaaaggaaaatctatagtgatagatcagtggttgctaggctttcaggtaggggaagaagcttgactgcaaaaggccacgagggaactttctggaatgtcgaaaatatttattctatgtcatgattgtggttgtggttacacgactgtatacatttgtcaaatcttactgaacagtacaattacaattaatgaattttactgtatgctaatcatacctcaataaagccgaaaaaaaaaaaagtcattctggaggagagaaatcattgcctgcggagggccattccagggtggtgagtgcatgagcactgaagacacccggagcagctgctgcaataatctgggggaggaacgtgcaggcagagagagcaagaggaagtcagactgggaaaccccgaggcagttacccaaacagcccactaacagcaactgcagtcggccgcctctggggaggaaagcgggaggggccactgcctttaaaaaagaaaaaaaaaaaaaatctctgcagttttgccagggagccgcctcctgcctgactctcacatgatgacctggaggccatctatgggtacggccctcaagccctcaacgctcaccctccttctaccccccgcccctcaccccagcacctgctggagaccctggccctcccttccactccgcgaggctcttaatctatccagttccatgggctgcctttccgcagctataaacaggctctgtccagctttcccagttattattcacttaggtgaatggacacaattagatgatcatccgcaggctgtcttcctgtcatcattggcacacgcacacaccctcacacacgcacacaccctcacacacgcacacaccctcacacacgcgcacaccctcacacacaacccccccaacgccacacacacacacaccacacaccctcacacacaaccacccacgccacacacacaccacacaccctcacatgcacaccctcacacaccacacaccacacacaccccacacacacgcccaccctcacatacgcacactctcacacacaccctcacacactctcacaccctcacacacgcacaccctcacacacaccctcacattcacacaagtacacttgagtttttattaaatttgtttttgtccccttcaatcccatcctccaacccgttgttcctccctatctcctgggctctaggtattctccttcgggtcacagtccctgtgagggccgttcctgttgacaggcacttggctccgtccttcccactgcccacaggctccaccatctgcacatgcacccctcccacacaatcgggggcctctttctcctcgtccttggctgcctcctctttgtcttccaccccttacaaatccttcagggccctttaaatgccttttccacctgcctgctccctctagccccgctgcccagtgttaagtgggtcgcaccatttctctcctgggtgacaggcacagcttccaccagcctccctgcctccactcttctctgcagaagcccatgtgctcctggggcagagcccaggtccttccatctctgcagccacagtgctaggccagcggcacttgcagtttggtgaatggaaggttctgatcatggggaaccggtagatagagagggacaaacagtgtccccccaatctgcctcctgtcctcttctgcccagacactaggctggaagatcaggagccacaccttggcactcacagagccctttctgcaagtcttagagggaccagtgggaggtgtgcacacaggggctgcgctggcaggagtgggggcctggcacacccccaggtagatgccctgcccgttaacgcccaagggcaggggcttgagtgactcatgtgggcctagcgtgaatcagcacagtctgcccttcttcccatgggagctgctgcccagccccatctttcttggcccccgaggggtggctgcccagggcctctctcctggcacagttccatgtagtgcctgcccatgtggctcccagttcctccccggggtcctggctgagcagaatggcactggatcctgatctggcttcttgcatcccagaggagaccgccatgcgggcccttcctccagattcttccctagtttaacaacaggaagcgaggagtccaggggggcagagattgccacgggcctggccacattgctaggggaggtcccaacctgctgctgagatccggcactgcacagcctcgttcaggcagagaaactgataaggagatggttgtctgctcaccccaaaaggttagcatggattcctcgccctagccggctttagacggagggaacaaaggctttcccaaggccctgccagtccccacccctgcccatcttaccaccgtagtctccctcaatcatcaagtcccattgcacagaaggggaagctgaggtgccaagagctggcgtggcctgttcaaggtcacactactgggcaggggccaagcaggggctggagccttgctttcctattccccagccagggtccccaaattctctgccagttgagggaagccatctcctattccactgatctgggtggcattaggaaggccttttctatgctcctagattagtgacagcatgcggttattggggacagcatgaggatgtgcatgcgctgaggagatgcagctgaagcgtcaggcctggggtgccagcactctgcagcctgcccccaaggggctctgcaaaaacatggcaaagatgcggggtgtgatgtgcacctgtgtgtgctgcgggtgtgtgcgtgtgtggtgttggctgtgcgtatgtggtgtgtatggctgtgtggtgggtacatgtgtgggtgtgtggcgtatgggagtgtgtgatgtgtgcatgtgtgtggtgtgtaatatatgtgtgcatggtgtggtgtgtgtgtggtgtggcgtatgggtgtgtggtgggtgcatgtgtgtgtggcgtgtggctgtgtgcatgtatgtatgtggtgtggtgtgtgcgctgtctctggaaaatgcccaccctgtgttcccaccaccctaacagggccgggaggggccagggtgctgccaggctctctgggcaggaagaggaggccttggccgcgggccggacttgggcctggtccgtgaggctgttttggtctctggcttcacaggcaacagagaagacagacaaacaggaagaaagcagctgccttgggctgggctgggctgggctggcctcggctgagccaagccaggcctgggtgcggggggagtggaaagagaactactgggatgggggctggagggggtgtggggacaggggaaggagagaggtgttgggggagggaggaggagggctcaggtacagggaaggtgcgtccatactcatggtatgttcaagaacatgagcgagcgtctctgtgttgtgtgtttgtggctgtgtggctgtatcatgtgaggttgtgtgtggtgggagggagcccgtgagcacacggaggtccccagcccctcttcctaggacaggtagttgcaggtggggcaggaggaagagggtgggggtgtccctggatctcacaggggttcgtgaagcctggcttggcccctgccccactcctccctttcctgtccctcgtctccggccaactgggccctaactggggaggaggaggggcctgcgtgggcctgggaggggcccagcgaaagtgttttcaccccttccttgcctgggcccagcgaggagcaggaggaccccaacttgggaagggggcgtgaagctcccatgaaaaagcagcgcagtcctgggccagacccaccgctctctggcctcagtttccccacttataaaatgggaatgctgaactaagtgacctcccagagcactgccaacccagacaatccaaccaggggggcgtggtagggtgagggtgggcgtggaggctatggcagtgggaggagggagtcctgggccgggaccagggaggccctggggaaaggaagggaaacaggaggccaggggaggcctgggggaaagggggagggggaggaagtcccctcctggccaggtcactcccagaggctgggctgggccagggcagggcagccgatggagagcagatctgagcacccagccaccttcacgccaccgcccagctgcccaggagcccagccaggtaaggggctgcgcctgcctgcccccctgcccagtccccagccctcggatggtggcctctctcggcctcggttggggcaggggagttctgcgtgtctgtctggggtgcccactcccaaacccgggactcatgggctgcctgggggatcctgggttctgtgcatccgtctgtctgaccatccctctcaatcttccctgcccaggactggccatactgccaccgacacgtgcacacacgccaacaggcatctgccatgctggcatctctataagggctccagtccagagaccctgggccattgaacttgctcctcaggcagaggctgagtccgcacatcacctccaggccctcagaacacctgccccagccccaccatgctcatggcgtccaccacttccggtaaggcttgcccctccatgagtccggtgggcagagtgggtttgacgattcagggaagcccctctttctaaagacctccttcaccctcacctctgggtgtgtctctccaggctgccaatgagtggggaggggagcacagccccacttccccgccagggctggggctggggctggggctggggctgcccttccttctggactgcatgagcctggggtgtgtatccctcataacatggctttcctggagtcccctctgctaggagccaggaagtgggtgtccggatgggggcacgggaggcaggcctgagtccccctgcacagcaccctctctaaccaggccctcttcccgactccttcccagctgtgcctgggcatccctctctgcccagcctgcccagcaacagcagccaggagaggccactggacacccgggacccgctgctagcccgggcggagctggcgctgctctccatagtctttgtggctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatctgcagatggtgggcatgtatgcctcctcctacatgatcctggccatgacgctggaccgccaccgtgccatctgccgtcccatgctggcgtaccgccatggaagtggggctcactggaaccggccggtgctagtggcttgggccttctcgctccttctcagcctgccccagctcttcatcttcgcccagcgcaacgtggaaggtggcagcggggtcactgactgctgggcctgctttgcggagccctggggccgtcgcacctatgtcacctggattgccctgatggtgttcgtggcacctaccctgggtatcgccgcctgccaggtgctcatcttccgggagattcatgccagtctggtgccagggccatcagagaggcctggggggcgccgcaggggacgccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggcttggccgcatgcccctgtgccccaccagccatcctgaacccaacctagatcctccacctccacaggggcgccctttgtgctactcatgttgctggccagcctcaacagctgcaccaacccctggatctatgcatctttcagcagcagcgtgtcctcagagctgcgaagcttgctctgctgtgcccggggacgcaccccacccagcctgggtccccaagatgagtcctgcaccaccgccagctcctccctggccaaggacacttcatcgtgaggagctgttgggtgtcttgcctctagaggctttgagaagctcagctgccttcctggggctggtcctgggagccactgggagggggacccgtggagaattggccagagcctgtggccccgaggctgggacactgtgtggccctggacaagccacagcccctgcctgggtctccacatccccagctgtatgaggagagcttcaggccccaggactgtgggggcccctcaggtcagctcactgagctgggtgtaggaggggctgcagcagaggcctgaggagtggcaggaaagagggagcaggtgcccccaggtgagacagcggtcccaggggcctgaaaaggaaggaccaggctggggccaggggaccttcctgtctccgcctttctaatccctccctcctcattctctccctaataaaaattggagctcattttccacatggcaaggggtctccttggatccgggtaacggtgggtgtggaggcagcacagagacatacacagactccccacacacacccacagtcacgtgcacagctctggaatccatggcgcaggcagccaagtcttcaaagctgcaggacccctggggaagctgttctcacctccagcacccacctgcccacccgagacagagagctggctcccatcggggaatcaacacgaggtctttatgaatcgccacccagccctgccaggcatctgagcaagggtacccgccacccagcagccactgatcagccttccacaaagctgcagaagagggctttccccagcatccttcctcagctgcctccaaaaggggcctgggccagggctgaggggcaggcaggatgtggagcgggcatccctgtgtgcacggccccatcccacctctctgcacagggtgaagtgcaggcaccctgcacttgctggacagggctggagagaagcaagggggctggggagagtggccggtccagcgggtagccgccgggggcacgcatctccagcagcggcacctcagtgtggcttgggggtcgtgtctaggccctgggggtgggaagctgagggtgaggctggggccccagggccccgggagaagcctttgttcctgcccaggcggctgctgggcggggcctttgggcttcggggcccaggactgggagaggtggtagatgctggcccaaggccctggcggacagaggtctttcccaagagctccttaaacacagagtccatgttctgtgccacagcctagcggaggggaaagaaagggagagtgaccagtgagttcccccgactgaccctgcccaagacccacctgagttcctcccactcccaaagcaagccctcagccaacatccccagtccctcagcctccaggtcactctcccccactttgcacctggcatccctcctgtccctgttggtgtctctgtcacagtctcctctgaggacagcaattccttggtttagcccggaagtggggacccccctcttctcgcccccactctttccctggcagagatcacagccccctgcccatggcctcagggaccgccagcgtgcggggactccccagtcaatgtcctcccatggcgtctcctggctgccctgtccctggctcccgctcctgctcctccgtgtctaccggaccctccctgggctccctgggcctgggggcttggccacacctgggacacccgcatgttcttgggctctctcctccttgggcttagcaactgtcccgcgggcttccacgttcagcccgacagtgttcacagggcccatggtacagagcacggagcagggtcccccaggttgtgcgcttgccagggccacatcttgagccttcgctctgctccttcgagagccgctgctgccccaccccaatccccaaccagccaccccctcctgcctccctgccatctgtccctttcatcctccctggcgtgccaagcgcctgccatggcaccgcctgttacctagcccagctacaaatgccagccttgaatctgccctggagtcccttgcctctaccaggtaaacagccttaactcagccctgccactccctgctctgaagctgaacatgaatcccaacgtgcaagccaggtgtcttctgtccctctcatccctgcctccgtagccgtccctctccatccccacccgccctcacatctttgccttcctgccctccacaggctctgccttgggcctgtgtgtctggcggcaggttcccttgagctaaggccagggagggcaacgactggaacctcgaggagggaggagtttggcttccaaggggaggcagagatcccccaggacagatgtccctcacctgccacacacccactctcaccttatccacctccacgtgttgctctggggaggctgggaccaagcagcgtcgtctgtgtccagagggtcccatggcctcaggtgaggtgcatggctctggcctgcaggacagacagggagcctggtgggggccctgggaagtccctgagctagctgggcagtggctcctcccatcctggggtgtggccaaggaaaggaggctggcccagtggtccccaagctcctctagagcctctccctgtcacaagctgggtcattctgtcacgtcctcatctgccaactcctcccactcccactggccaaagcctgaccccagtcccctctggcctagaacagcacacgtgtggccccctgagccccgtcttcttgctcaccggtggaccagctccgatgccaggaggccctcgggactgctcccagactcccctgcagtctgcagccctgcgcccaccacctgcttctccgtcctgcggtgggaaggaccggcctgtttcgagtgctccttccctgcacggggtccagggccagcagcctccgcgccagccaggagtggtcagagaggctctgttctctggcccagcccagaccttcagaatctaacttggggtcgggggaggggtggatgaaggggagactccgggagccctggggcctgagggcgcggctcactcacccggcgggcagcgtgatatacttgtgggggatgaggccccgcatgccgttgtgctccccccgccaccagtcgctcgaggccctctcgtgcagccgcagtacgtccccccgccggaagctcagctcctgggctgtgcggcccgtgtaggcaaagcaggccacagcctccacgaccccctccaggtctggggaggagagggggtccaagctgtgggagggggtgtggacactagggtggggacagggtggggctctctgcccatcgccctcaccatcctcctgtgcgggcatctcggcttccagctccggctcattgtccgcccccaggctctccagctgggcgtccctgaggttcagggcagagcgaggcagatgaggggggctcttctccagtggaccccccagtcccctcggcagcaccaagggtgtaccccaggcagctggcggaaggcggtgccatgcacttctcgtagacggggccaggcagcgaggtcaggggcgggaagacccgatcgggctgcactatgagcgtctgcaccagctggttcacccggccctgcagcgccaccgggtcctgcccagcgggcaccggtagcagcgtgggcccgaagcacacggccaggttgtaggggtccatcatgttctcatcgctgtactgggccaggctggggggacacgcacatcacaagcagagagcccgcaccccgagtccccctgtcccctcgacccctggcccccaccccagcactcgccccgcagcactcactggttgaggaaggtgaagaggtagcgcagaaccaccagcaccggcgcgggcagccgccacagcaggcggctcacgtgctccaccctctccgctgtggcctccagctctgtggccaaagccgcccagagagagccgcgtgagcggggctgccccagcaagtgccctaccccgccagcctcaggccccagcctcacccgaagaagccagcagctcgccgaacaggtctggggggaagagtgggggctccaggctccggaagtagagcttcagcaccccggccaccgagtccaggtcatgggcagtgcagccctccaccagtgggtcctcccctgcagatgggcgagtggtgcggtagggggaggaagctggtgacatctgcccgagcccccacccccgcccgccctgcccgtccccacctctctcgaaggcatcacggatctctgagacccggagctgggcacccgatacccggaagatgccttcatgctgcaggcctgtgggaggacaaggagctggtgggcactgagcatcttccccagcccctccaggatggcctcccatgccaggtgctgggaactgggtgctgggtgccaggacatcgggaggggctgggtcctgcttaccattgaggttgatgaagcgaatgcagctctccaccaccaggggcacaggctggcctgagctctggggacagagggtgtttacttcaccatggacacagcatgccctgtgttgtcattcaattgctttttttttttttttttttttttgagacaaggtctcactctgtcacccaggctgaagtgcactggcgtgatctcggctcactgtagcctcagcttcctgggctcaagtgatactcctgcctcaagctccccaatggtgggattacaggcatgagccaccgcaccaggctgagtgcttttattttctctgaagaacacatcatcgttgtcggcacagaggcttagcacaccgtttgttagatccactcgtaggtgtctgatatttttgatgaggttttaggcagtgccttacgttgtatttgcaaattgttgctggaatatacaaatgcaattgaattctgtacaccaatcttgaatcaagtaacatttcaaaactcaagctgggtgtggtggctcatgcctgtaatcccagcactttgggaggccaagggaggaggatcacctgaggtcagaagttcgagaccaacctgaccaacacggtgaaacctcacctctactaaaaatataaaaattagccaggtgtgatggtgcacacagctacttgggaggctgaggcatgagaatcgcttgaaccccagcaggtgggaggtgaaggttgcagggagctgagatcgtgccactgcactccagcctgggcaacagtgcaagaaccagtctcaacaaataaaaaaaaaaaaaaaaagaaagaaactcaaagtgctcgtttaaagaatctgttgattcttttgaatatgctacacgcataaccacatcactgaaaatgacgatatcagttctgatcttctggtattctccatgcctggccctctctgatgcttgcttgcttcttttcttttctttctctctcttttccttccttccttctttccttccctctctctctctctctttctttctttcactgggattacaggcacgtgccaccatgcctggctaatttttgtatttttagtagagacggggtttcaccatgttgcccaggctggtctcgaacacctgggctgaagggatctgcccacctcagcctcccaaagagctgggattacaggtgtgagccaccgtgcctggccccctctgatgctttctgatctcagtattagttttctgatctttcttgcttccccttatttcactgtccaggacccccagtaccatgctggccagaagtcgcaggggagaagctctcaatatctcgcccctaaaaatgccgctgccccaggttttctatacgttcccattactagttaaggatgctcccttcaatcagcggaggctataggggagcccaacagtggcctggaagaggcccacccagaaaaggacagttgatgactgattgagagtggaggaccctgggatcaggcagctgctccggccactgaggtgacccagagctgaagaaagatcagcatgtacaggtgggctggcatgtggggcaaagctagtacctggataaacttctccatgtctcccccaaagagtctctggttatactgggagctggggcggggctggcggctcttctggaattttctctgtgtgtactgggtcctgcagtgaatgggagctggctctgagggggccaggtgtggagaatagggtgccccaccccccaggccagccaagccggcctctaattctctgaagttattccacaatccagtgcgaaaactggggaagtgaggcccaggggattgggcagctgagctgggccccaggaagagaagagatggcggaccgtcgcagggccccagccctcagggaggactcaccaagacacctcctgctcctccttgtcacctgtggggtgggagaacattggtctgcctctcgggccaggggtcttcaaggcatcccagagagaaaggtgtggataagagccaaggacaggcgggaggggaggaccgtgggctagacagggtcctgggcaggggagaggcggggaagggggcagcactgggcccacctcgctgaagggcctcctgcagcttctcgtgcttggcctgcagcttggcgaggatgctccgtccactcagatactcctggagcttctgggcagccccaagaagagccccaagtgttagccctggcttgagcccctccctctgccccagcaatgcccccacgggtcccgcccaccagcccagccctccccaccgtgaggtagaaggtttcggtctcctgctgctggccgcgcctccggcccgcctgccggctgcctgggtctgagctggtggacttgagggactcggtggaggggctggtctggaaggaatcaagcacatccccgtcatccgaggccaccacctccagcagggcctgcagtgtcgccttcagagtcttgttcacctgcagaggagaccacaccagggtggtaagaggtgggggacagggagggagacaggaagtccaagtcagaaggaaggggccaaagggaggggggcaggcagggcagccacttccaacagcaggctgtacaggctccaggccctcgtctccctctaacccccggtgggctgcccagacctcctctgtctcaatggtctgtcggtccaggcggctctggatgttctgggctctgggcagaatctcgtcccgcagctccatttcaacgcagatctcagccacctgcagagggcggcggccagggggctaagggctgggcttgggcagtaggtgccaagatccccggggcataagggaagcaagcacccttttgtggcctggcggccgggcacaggaccaccagcccagacgctcagctgaagaatggcaggagtgaacacacgtgtccaaaccaagacttgtccacagaggttcgtggcggcaccactcatccaactgacggatggctaaactcagcgcggtctacccacagaatggaagaggattcagccacgagaaggaatgaatccacttatgtgaagtgtccagccaggcaaatccatagagacaggaagcagagtgggtgccagctggagcagtggggtgccagtggggctggagaggagaacggggagtagtggctcctttaggggtgacaaaaatgttctggaattacatggtgatggctgcacaaccaccaaattgtacactttacagtgctgaattttatggtatatgaatcgtaccttaataaaactctatttaaaacagaatggtggcccggcgcagtggctcacgcctctaatccaagcactttgggaggctgaggcggatggattatctgaactcaggagttggagaccagcctggccaacacggtgaaaccctgtctccgctaaaaatacaaaaaattaactgggcacggtggcatgcgcctgtagtcccagctacttgggaggctgaggcaggggaatcgcttgaacccgggaggcggaggttgcagtgagccaagatggagccattgcactccagcctgggcgacagagcgagacgccatctcaaaataaaataaaatgaaatagaatggtaaggaagactggggtctgagacagaacagggagagcccagccccacctcttccagggaaaggagtggacggaaaaactgctcactgtaactgggcagacataaatttccctgtggcaagatgagagcagcttgcctcatgggcagagtgggagccaacgctttagaaaggaaggaattactcttttaagcatgtagacatctagaaaattgacattacagttaaaattgagagtgaggattcagctgtggctaaacacttgccctgctctccatctccaccaagccccgccgtacaggactgcatgaaggcgcaagtcacagagtagaaagtaaggccattttgagatgggctccaacatggctgacccttgaggacatgggactcagtgaaaggagccagtcacagaaaggcccgcactgtaggattccactcctgtgaggggcctcaaaggagagccgtgaactctgtagagacggacagtggaagggtgggtgccagggctggggggtggggagttggggttgaacggggccagagcttcagtttgggaagatgaacaagttctgcggctggatggtggtgatggctgcacagcaccgtgaatgtgcttctgcccctgggccgcacacttacaaatggtgaacgtggtatgttttatgctatgtgtattctgccacacctttttttaaaagtccatctaggctggactggctcacacctgcaatcccagcactttgggaggccgaggcgggtggatcacttgagcccaggagtttgagaccagccttggcaatatggtaaaaccctgactctaccaaaaatacaaaaattaccctgtctcataacctggtctcaaaataaataaataaataagtaggttaaaaataattgtttttaaagtacaaatcttagccacgcatggtggcatgcacctatagtcccagctactcaggaggaggctcaggcaggaggatggcttgagcccaggagttggaggctgcagtgagctatgatcacaccactgtactccagcctggacaacagagccagaccctctctctagagaaaaaataagtgtatgcatactctggggaacattgaaattttatccctcctctaaactcacacgatcagcagaaaactaacaatttgctctctggaaaggatatagcagggattttggactcagggacactggtcccagatgaggaagatgagagaacacagcagccccaccatcggaagctggcctggtcctatcagcccggcctcagtgctgtcctgctgaacaccggaaatgacccagagcatcaacatcaggcaaggccactgtgtgaccttgatgggcgaagacagaaacaagaccactctgcgatcacgcatgagtgaggacaaaatcaagaacttcttccgagccacaaaatcatccctccatcctggctaatgtaagtgactgtcacttccttgcatcacttcagcctccatcactgtctctttctagataagattaatcaagacatccaatcatacaattaccctgcttccagaaggcatccaatccaggaccaagccccacttacctgggccctcccccagatcccctaaggcaagcccaagtcctctaaggcctttccactaccctctcactgagaggccccaggctccccacggagcagggctccctccagcaatggagattatagggctgttcctgctaggctttggctggagggtgtggaactaaaaccaggtagttccaaggaaatccacacagcagagtgagcccccagccctctcaccccctctcctccctagacagggtcagaagagtttctactggggaaactggccgggccaggaggaaacaccacagacacccacatttgtggggtatgtgttcaggcctcttcttaaatatgaactgatggccaagaatcaccaaacagacacgatcagcagaaaactaactatttgctctctggaaaggatatagcagggattttggactcacgaacaaaagcaagaaaatagagcaaatgcaggaacaggagaaaacaaaaaacatttcaggccgggcatggtggctcacgcctgtaatcccagcactttgggaggctgaggcaagcagatcacctgaagtcaggagttcgagacaagcctggccaacatggtgaaaccctgtctctactaaaaaataaaaataaaagggtcgggcacggtggcccacacctgtaatcccagcactttgggaggccgaggcaggcggatcacctgaggtcaggagttcaagaccagcctggacaatatggtgaaaccctgtctctacttaaaatacaaaaatcagccaggcgtggtggcgggcacctgtagtcccagctactcaggaggctgaggcaggagaattgcttgaacctgggaggcagaggttgcagtgagccgacattgcgccactgcactctagcctgggcgacagagaaagagtctgtctcaaaaaataaataaataaaataaattaaatttaaaaaattaaaaaattagccaggtgtggtggcaagtgcctgtaattccagctactcgggaggctgaggcaggagaatcacttgaacccaggaggcgaagtttgcagtgggtcaagatcgtgccactgcactccagcctgggcgacaagggggaaactccatctcaaaaaaaataaaagcttcagaaagattcaagaagtactgtattcatgaaataagaataaagggttggccgggcacagtggcacacctgtaatcccagcactttgggaggccgaggcaggccaattgcttgagcccaggagtttgagaccagcctgggcaacatggtgaaactcccttgctacaaaatatagaaaaattagcctggcgttgtagtgcaggcctgtagtcccagctacttgggaagctgagatgggaggaccagaaggttgcatctgcagtgagctgagatcacatcacacccctgcactccagccgaggggacagagtgagaccctgtttcaaaaacaaaacacaacaaaacaaaacaaagaatacagacattttcagatgtgcaaagtcaggaaacccttggtgaaggtgtcaccaaaataagggtatcaaactaagaaagctgctgccgtggaatccggaaacagagcactgggcagaagtgaagcactccagactggaaggctctgggggagggcgcagaggagaaggttgacctcacaggtgcctggtgtggaggacagtgctgggacgaggtagcgatcaactcctagcaatgggcatgttctagcaagcagcattcctgaggcaagagagttataaattccagaagaaaaggaaaaattgtccaaggaaggacatgtgatcctaatacagtacatggctcagctgccaacagtacctgttgtcatggtgatttaaacattgaatgttaatttagccaaaaattctgggataagcccactgggagaacaagatgcagggaagcgtgtggtggctgtgagagatgctggtggcactgggtcatcattggccaatggaaaatggctgcttgacaccgggaggtgggtggctgtttctgggggtgggagctgggaacgggaggggtgggttagggagcagctgtgacgccatcggaagccctggtgatgccggactcttcgtaaagttccaagtcggcccgaaaggggcccaatgtaatcccagatcattgacaatgcccatcaggataaactgctgcaggaaaaactagctcgacggagaaggataaagaagccccattccatcttactgccaagtttgtgtcacgaaatttaaaaacacagagaaaccagcctagaacaatgtatgggcagctacacggctgcctgctgcacggtttgaacagttagtgtcttgccctccttggccattgcgggggtgcacccttggagtgaggctgcaaatggaagtgggacacttctctagctgccgcactgcctgagaccatggagaacttggattcctgagcaaagtgtgggtcatgccactccactgcccaccattacagtgaaggccagagaatgccaagcccagcagggggtgaccctcacctcatccccatcatgggggtggtagtcaaagcgcagcgggggacagaagacggtagcatgcacctcgagaaccttggctttgtcccctggaggatccagggcctccacagcttcttccaggctgcccaggccctgcacttgggaggcttgggtgcggctctcagcggccgtgtagctccggagcacctgccccagggccaggtggaaccctgtgtcacagcactgaggaggaaacaaggagatgcttgggtaggtcctggagccacagcttcccagccccgaggcaccaggcaccttttcccacctgcccaccaaggactcacgtccatgaggtccaagacgtcatgcaggtagtagttactgacagcagcgttgacactagccaggctaagcaggtactcgttgcgcgcctttgtgcacttgagtttgtgctccatgaacttggcctgccgctactcaagacaatgcaagcgtgccagggtcacgcacgtggccagcccctatctctagcctttcatgtaatgcccatcgcctcccctcccactgtggacaactacacctgaactggtcaagcccagaagtcctgctgccttccccacgccacagtccacagtgtgctcagcccagtgccaggaggtgacttgattccccggctgttcacccgccacttgccttggttcgagccacaacattccccacagaagtgggggatgacacagaactattcacagatacctgatgagtggaaggtgcgcacatggcaccccaccatggagggtgcacgagaaacccagcttggagccagcacacaggtgcacagctggaagcggccacaggcctctgcgggggccagagctgagggggaacgagtaccccaaagggtagggatagatcatcaagagccatgaaacagaacctgctggcacctgggttctaaaactggcactctattttttttttattttttttttttgagacagagtctcgctctgtcgcccaggctggagtacagtggtgcaatcttagatcactgcaacctccgcctgctgtgttcaagtgattctcccgcctcagcctcccaagtagctgggatgacaggcacccgccatcatgcccggctaatttttgtatttttagtagagatggggtttcaccatgttggccacactgatcttgaactcctgacttcgtgatccacccacctcagcctcccaaaatgctaggattacaggcgtgagtcaccgcacctggctaaagctggcacgctaaccacagcagccagggagaccttcccccaacacagccaaactctgtcatttcccctaagaacacctgagatgctcgactccctcctctgctcccagagtcccagagaccatgactgtcagccacgcacagcctggcggctccatccaggcatttcccagcctccccactctctgtactgggctcacctcgaaggccctttctccgtgcgtgtcaccccatcacccaccctaagtgtcttcttgcccccctctgaaaccttacggaatggctggcagaacagcagagctgcaggggccccgctgggagcatggagaggctgcatggggctgtccagggccaggcaactgttttccccactctctcaggccctgggagccttccgtatggaatccctggaacctgatggcactgtcctgccactcctgccctcccctgcacccagccctgacttccccctcagcacagcaggtcctagttagggcccatggcccataggcctgcgtctgaggtgccctccaggcccaccttctccaccagcctccctcccttcttgagggagctcttgcggaggggccctgcctcagtggcaccagcggtggtggtggggacactccggcctgcccgcttctcctcctgccgctcggcctcccggagcttggcctcggcattcacgctctccatgtgatatgcctggtacgtcttcttggcctgcagggagacccaaagcaaggtggtgctggtgaaggccacggctgggccagcccccagccctctacccctgcccctctggaacttggacctcagagctgggcgatcccatgtgagcacttagcctaacgccctgtgcctagggagagaggcctttgcccctaggtgcgtgcttctccctgagcctggcttggggtgatgtgatggtctggcggtgttcctccccactgtgagtggcatttctccctggaccattggggcaggcccctccccagccctttcctcaccgtctggagctctgagaccacctccaggagctcatcctgcagctgctgctccagatccctgctctagaggcagaggcaagggtgagcacggcactgcccagagcggccccgccaggcactggaagctctgcccagatcaagccccatcgggggggcacacaggttcgctctgcctgctccccacctggcctccagtgccctcccagccacagtgcctcctgatcccaaagcctcgaacacttcccgtggcccaggatgagagcctcaccttcttgaccaggcgccccacgtcctctgcaatgtgactcaggcgctgggccaggggcccggccagcacctcactcagggccgcgctctcccggctctgctgccgcgtgtgctgcagcagcaccgcccagcagtgcaagggcgacaggagggacggctccttcctgggggtagaggggcactgagacctgggagcggagcttgggccctgccgtggcccccctgccagcacatcacctaccggaagctttggtgctcccggctgctccccaggcggcctccacggctggagaagcgctcggccagcttttccaggccccgggagtattccagctccacctcagcgcggcgccgcatgaactctgccagctcctgcagcaactcccgccgcagctcgccctgcagctccaggcagcgcagctgctcgctcagctgccagcgcatctctgtggggggaaccatggctcaggcctggtcagcacgccctgcctgggtcagccaggccagcgtgggatgggagaggcagaggcacacagaccccagtcccgtcggctctgagggctccttcggacccagcctaggctgagggcaagagctaagaggggaggaaagaagctaggcccctgcaggcagatctggcctcagctgtccagccgacctctgcgctgaggccaacagatggccagagccacccggttgagggggaaggggaagggtgtcccagagagaggggagagccgccccagcgccagccaggcacctttcagtttggcttcctgtctctccctcgttcctggaaagcctctgaatggtttcccctgcgacttcctttcccgccggtacccaggctccgggaggtggcagcctcccttgcaaacacacggatacacaacacacagatcacagtgctgctcagggcaagcctgcagcgatctcgcagtctcagtggctggggaagcctgccctcaggccccaggggaaaggacagtccacagtgagggctgggagccagggagagctgatccggccttgtaagtgaaagaatggggcagggagctagcccccgtcttctgaccccacttcccactcccaatcaccccccgccccacctgtgcattcccccaccctgcagagagagtcacacccagggccccatactgccggccttttgacaccctatcactggcttgatttggcaacgctgcttcccccacacaggcctgaagcaaagaagtgcctgtccagcaagtttaagcaacctgcggaagacacttttgccatctcctgagtgcccgtcccgagtaaataagatgctagctcagcttctggccagcaggctgcccacctactcatctccatccacatccccagggagggacatgaattgatgtcttcattcagcagaatgttgattatgcacccattctgtggcaggcacgttttaaatacaaaggcaaagaggtttgaccaagtgtctgccctcttggagctgggattggaatggggcacgaacacatatcagaatgcccaggagtgatgggtgcggagaagatgaacccacaaagcaagatcagagccaggggtgggtggggacagggaggacctctttttaaaggagggtggtcaagaacaagccgcatcgttggagcagaaggctggagctggctgtacgtgggcagtagggggagtccgagagaccggtagggacagatggcacagagcccggggtctgggcagagctcccagctggactccgagtgagagaggagccacagtagtggggtgatgtggtccagcttcgttttcagggccccctcacactgccaggtggagcccaggtggcagctactgtgctagtccaggcaaaagacggcaggattcagaccagcagcagcgagggaggactccgctgagaagagctcaatcccattggatttctgtcccgccagtgacttcccaggggctgttgcatggggaccctgtgggttccgcctgcccagcatccctacctcctcccctgatctcctattggagaatgtccccttcctagtctcagcccccttgactccaggtgccccagccctggctgcatgcgtcacccatccctctgtccctccactccctgcccccaccagactagccaggtgagggacccaggagcctgacccttccaattgaattactgaacaggagagctcttcccaccggcagatcaagctgggtaagtggaagcctggggcacgggacctcccgacagagcagggcagagcccacgatgccaagtgagacagatggagagtgtcttcatcctatccgaggctggcctcctgtggttaactcgtcagctccaaggccaggtggggtgggcgctaatgccatttgaaatcaggagagtcctcactgaatcagtttaacgttttgttttgattttttgttttgagacggaggatgttgcccaggctggagtacagtggtgcgatctcggctcactgcaacctccgcctcccgggttcaagcgattctcccgcctcagcctcccgagtagctgggactacaggggcgcaccaccacacccagctaatttttgtatttttagtagagacagggtttcatcatgttggccagactgggtcttgaactcctgacctcaggtgatccgcccgcctcggcctcccaaagtgctgggattacagacgtgagccaccacgcctggcccagtttaacattttttgataaaagtaaatttcatttcattccaagaaaggtgttagacaactgctcgcctcactggccctctggagcctgccctgccctgcttcccccagaggaatacaatccctggggacttatgacaactgaacagtgcagaaggaaccagcagagggaaccgctgcctttcttcatcactgccggcagcaaaagctgactggaagccatgtcctagtccagatccgggcatgcacaccggctggtgttgagcaggcaacttgtgaattgcaagtcgattgcattggtggctttcctggcagagctttcggatctcagttcagacaaactcgtcagcacaccctgtcctgacctccccctaaactagggctggccctcttccgaccccttcttggcaccgtgcactttccttccctttgtagtgcttattatcataatgcaaagtctatgtctcccccactagacccgtgagccatgtgagggcggggtggccactgacgccatttgaaatcaggggagtcctcattgaatcattgcttttactctgggtaaaaagccagggctggaggggctggagtcggggttctctctggtacagcagtatactcccagggcctgggacagcacagatgtataggaaacatctggcaaaaggagagctggaatccatgtctgcctgaattacagagctgggccccgggccccaccagcacttcctgtgagcaaggcatttggtctcacttctgctgacaagcaaaacagaagaaaagatggtctccaaaaccaccgctatgctgacctttgagaatttagggtgtcaagacagtgaccccactttgtagaatggtaggaagcttttccagggtgtgggatgcagacccagagcaagtgaggaacccttagacagtcgtgctcgaaaccccaacttttcagtgtgaaatcactgacccatatttgctgactgaagttttccaagtctttcagcttcatggcattttggggaagcaggatggagatcattacctccatctgagcaagatgatggcgaggcttggaaagctggctcaccctgtgtagtcacctcaagctggctctggacacaggctgccttttccaaaggaggactggagcatactttggtataaattgcttgcactgaataatgatgttagaacctacatctctgggttcaaaggcacttcaagggtcattgcattctacgtcctagaagttgcagtgctgtatgaccacgggcaagtcactgcacctctctgagcttgtttccgtaattggtaaaatggagtgattgagagtgatatggacgagctgctggcactgagctgctgcctctttcctttgcaagagttaccatgccctgaataagatgggcacaagctattggctaagaatttgcaaagctgatttgcatgtgatttgcacatgggtgtttatcagaacccagaggttcaatttcagaaggctgagaagccagccctgttaaatctctcaaccaagactcactgcgccagcttgacccagagacagtggccctcgcctctgctccccctcagtgctaaagggaggcaaaaggtgctgaagctccagggactgcagtggggttacggccaggtgatctccaccaatccactcacccggactcccttactcaccccccagcccaatcaagctggttgacttcactgtagctaaaatactgccttctgaggggcacgttgggtgcatctggctctcttttaccagcggccaccagtgtctccactgaaccttgggtgagaagcggtagacccaaggaggacagagaccaaaggaaggaagacaggaaagaaggaagggaaaatggcaggcggttgaggccaaatgggcgtcgggaggcaggcaaggggctcaggctccctcctccacccccgctccagaggtcgctggggagagcatcgggccctgggccagcgcggggacgcttggagctccctcacgaccttgggttctccgcaggaaacgggccgggagcgcccggcgccctctcacctttgacttgcgtctcatactcagcctgcagcccccgctcccgccgcagcttcccgtgagcggccatggcggcctcgcggccgcgccgtcgaaccccactgctcccacgcggccgtgagcgggcccggcgccgggacttgggggcgctgcggccagcaccctgcgcgggctccgcccagccccgcccccagcgcggctcccggtggggcggggcggcccagggctggcactgcccgcgaggggctcctgggggggcagggcgccccttccagccccactgtgccccggccttgccgtcccctcccattgggcctgcacctaggctgccttgtgcccaaagccccgctgccaagcagccggagcaggtgtgagagccccaacgtaagctggcatcccaggctgccatcccaccacctccagaaggctgtccctggtcaccactgccagactgtaccattcacagcggggccgctggcccactgtaccagtggccatgaacaccattgctgccccaggctctggactccccctgggttgcctccttcccccagacatccgatggggtcctcccttcccaagtcagcccccagagaggcccagggagccccagggagccttgagagctggggtgggaagttcagaggggagggggaaggaaggtcagcaccagagagcagaacctcagcagctggctgccgttccctccaggcccccttggtaggggaggagagttcagctccggttccccttctgctcagccccacaatttccccataggcggttaccacttcctgctgccggaagagactgctctgcctcccttcccctgcagctgcacctgcccgtcataggcctgaggggggcagccccctcggagtgaggtcttagctaccctgggggcaagtcttggggcccccctcatccaggggtggtggggctttcctccaccctctaccacagggcagcagcttttctccgggaaatcgggaaggcgggaggcgggaggcggttgacaagccaagcagacaactggcttcaatttggtgggagggaaatccctggggtatagatgtggggagagaggcaaggcacttgggcaccaggcgtgtgttccgaaggcgggcgtgggggcactagtgcaggggtactaggcgtgtgtgtgcacggatgtcagagtcaggctctgtgcaaatgcgggcacacatgaccttgacctgcagatctggggaggggaggctgtgcgggtacttcctgcctttcaactgtgagcaattaattctcttgcccagaaggaaaaaaacactccctcagctccccgcccccttctcccagtaccaaggcccttctcgaacacgtcgtcgtgtgtgtctgcaggacctggggcttcaaggcctgggagctagccagacccaggacctggacttccagcagctggtctcggaagtaccgatgttcgagtcctccagcgagactagagagcctgcgcccctgcccacagcgcgtacagccgcacccacactccaacctgctcctggtcgggagactcacacgtcccaccgctgcctcaggccaaggggaaccagggagccccgcctctcactagctggccccaacacatcttgcccctccatccgagccctgactggtccccaaaggtccctccacccagcagagccagccacagggctcaggcaggcaggaaaggcctcagccggtgccttcaaacgctctcttcactccttttttcactccagagctattcctaggatgccccattcagcccgtactttagggcctgagtgttgggccctggcttttagggcacttgtttggcatttaaggccctgaacgcaactgccccctgctgctccgtctatccttcgctccattgttccccttcaaagcatccaaaagccaggcagcccgcagaaggcgcggacctgcccgcatggggacggaggctcagcggccgacaggcatcgggcccgccggggacggacggcagagggcgggccgggtcccatgggcctggccggggcggaaggagggcgccgtgggcgccgtgggagcctgggacacctcccttccaccggtgccggggcgcggccgacgcagtgcgcaagcccgcccttcccccgcaccctgcgcgcgagcccagtgccgccggaccaatcagagcctgggaacgaacctcgccgcgggcttgcgaaccggaagacactgccgccaggcgcggggcgggacaggactccgcctccggcccatacaaagggaagcccacgtcttaagccaatcaacacagcctcgcccgagccgggaagcggagagctgtgggcgtgcgcagacgcgcctttccggccccggccccgccctgccgcgctctgggctccgcttccacagctgccggctgcctgctggtcacgtgcgaggcgccagccaaagagaaccgagctccaggcctgtgtggcgagttttcaacccggcggaggagcagtgtgccacctgcagtagcaggacacagagagggctcaggaatacagggcccgcccaggactagggacagtaaatgatggctttgcagccggaggggagggaagggaaaggaggaaagacacagaaacgagcgttacggttagggtgactccatgaaaaacaggattttgatatatatgtgtatatgtatatatatatgtatatatatattttttttttttgagacgggtctctgtccctggagtgtggtggcatgatcagggcccacagcaacctccacctcccgggctcaagcgatcctcctgcttcagcctcccgagtagctgggattacaggcatgcaccaccacacccgggtaagttttctatttttagtaaagatggggtttcgccatgctgcccaggctggtctccaactcctgagctcaagtgatcccgcccaccttggcctcccaaagtgctgtgattacaggcatgagccaccgcacccaacagccgcccagttttgtattttgcatgaaattgttaatgagggaatacatggctttatgcatttgtgtaaccccatagaaactgtacaacacagacaggaaacctactgtaaaccatgggctgtagtttacaataacttatcagtattggcgcatcaacaataacaaatacaccaactaatacaaaatgtcaatggggaaacgcggggaattgtactaaaaataaattattttcaaatgcaaactcaggttagggagtagactcaagaggtatcatggactcactgaccattagggtggcaggggagggaggactcaaggactgttgatggggcatctggctgggtcattactcagacaggacatttgtagataagcccaatgagcagttggatgtccacatctggagcccacgggtatgctggggagctgctgtagcccgaagcaggtgtgattagggagagaaagtctgaaggtgaaggtgggaagagaactgaaggccaccaagagtgggagccctgctgttgagctttgagcctgagcagccccggcttgtgccacaaaacacattcagcgtggccaagcagacctccaaggcagggtctctcccataagtccagggcctccttccccggggccacagctgctgaaggtcatgagactagggagtcccacctccaaagctctttccttgtactcgggcctggcaggatgctctgggtcaaaaggccaaggctcacatccccaccagaggacctggagaaacacaccctctaaatgtgcgcgcgctcacacacaaagttccccagtgccacggagcgaatttattgtgaaagctcgtggggtgaggaggggatggggcaggctctaggaggctgagtcggaggcctctgagctgtccttgacatctgtgctctctgtggtctcgctgacctcgctgaggtccttgctgtccccaccactatcctcggcagccaggcccttctcctcgcgacaggcctctcctgagctcggaggtgaattgcctttgctctccaccttgttctcgatggcacccagcaccacgtgcctgcccttctctttcagctccaggtgccgcctcagctgccaccaggaacccagggagaaacgggggcaaagagacagggcctaagtttccagacaaagggagcctggccctgtcgctggctgaggagaggggcatagtgaggcagcagggctaggcaggacacgcgggactgagtggggacacctggctggagccccagtccaccgctacctgggcttaccgactaccatggaggcccccacgacagagcgctgccccttgaccagccctgccacccgatgagccttgggcagaaccctgactcagaactacctttgagcaggcaggccacccactggtccctagacctccccacttcccttctaaaagcctcctccctctgcctctcccatcaccctccaggctgctaggcagatggcctcctctaaagcccagcctaggaaactgaggtcgtgactcctggcaacgtagccacaagagctggcatccaaagtcggtctcgcctgcagccactgtcttggggctcctgagtgccgcccccgctcgccttgcttggcttcatgcaggcgcttacctcgtcggccatctgagtgaggtcccgcttcatggcataggcgtcctccccatctgcatagtatttgggctccacttcactgatcctgggggcagagggttagagagcaaggaggaagacctgtatcccggggacaccctcctccactcctggtatcgtggctactggagcaaggtgccatgttttctccctgaaggctccatcctgagacaacaagtccagtgtgacctgccctctgttctctccagcaaaggctccaggacacagcggcccgccccacccgtcctgcccccgttctgtgtccttagcctggatactaaggatccatttctgcggtttcttgtgagctgaagccctgaattcagccttccccttccctccctgccctgcgccctgtcccttactgagctgcctcacaacagccatcagaacccaggaaagacggtgagccctgcctgagcagctctggggccgtgactacactgggcaggtgtgtgtgcagactcgcgtggccatgtccctggaaggggagctggactcaatggcctaggctggccctgccaggcctaagacatgaggattgctgacttagctataaagcaattcccaccagacatcgtcatctgggtcacagatccctcttgccagcatccagcccagaggccaccgcccttcccaacagtccctcttcttcatcccctaccaaacgggctgagtgcagttagtgtccctccacaggcagcccaccccagcttcacttgcaagcacttttttccactgtctactgggcatgccaactgccaggttctctctagtgtgctaggcacacggggcctcctggtcctcaggcagacctcccccatccactaggctgcctggccactggcccttccttcctgaatgtgcattctcctcgattctgctctctcttggattcttctaggtgcttggtcatgcttgagtcctgctcctcagcatctgctcacgccagggacccacacctctctattcccaaacattactaaacagcccgtgtgcccttcgccagcctcagccatcatgggccagagctcctccatcacaacacatggagcacgtttcagcaggcaggtgctgtctccatgccggcttttcaaccatcagccgccgagtgaatgtggaggtatcctggcagtgctggggtccacagcctcttccccacagccggcccacccccgacctggaaggcaactcagccggtctcaggtgccctgatgggccagacctgggatcaaccccagcccattagaaaaatcgagatctacttactgaaagttgagggtgttggaatagaggtgcagggcggcccggttactgcaggggaacaaggcactgctgagctgcacggatttggccagggaggggtagcacgtccaggtcttgcccctcctcctggtccctccttccccccaatcccacttcctggatcttcaccaaaagctgaggtaccccaggacccccgtcaaggcagtatctctccccctcaatcccccttccctcagcccggcttccacctcttcctgacatgcagggagacatatttggcattgaagttctctatcatggctcgagaggcctggtccatcagtttctgagccagaccgaggcgccggtgggaacgcttcacagcctggtgggagaagagcagagatggggtgagggactgggaccttgagggctgccccaactaacccccacttccacccccaccagagagcctgggtggaccttacataccaatgaggtgatatgtccatggggcacatcatctgggtcctcttccctggagagggagaaaggagaggctgcaaaggagctcagtgtaggcacagccacctccagcccccctgccatttgtagagtggacatgcactacagccccctaagaccccagctgggggagagccgggagcctcttggatcagagcagccgatcctgccaccctctgctgcctgaaaaccccaagcctgccgggtgtggggcacacgcctatagttccagctacttggcaggccggggcaagaggactgcttgagcccaggagttcgagaccagcctggacaacacttttttttgtctctacaaaaaaaaaatcaaaaaattagctggatgtggtggcgcatgcctgtggtcccagctacttgggaggcagacatgagaggatcacttgagcctgggaggttgaggctgcagtgagccatgatcatgccactgcactccagcctgggcaacagagcgagaccctgtctcaaaaaataaaaaaagaaatgagctgtcaacccacgcaaagacaaggcagaagcttaaatgtgtattactaagtgaaaaaaagccagcctgaaaaagctgtatatagtatgattccaactctgtgacatcctggaaaaggcaaaaccatgcaaacagtaaaaaatcagtggttgccacgggttaaggagagggagggatgaatgcgtggaacacagtgaaactatcctgcgataatatgaaggtggacacatgtcatttggtcaaaaccatggggcttacaacacaaagagaagtgcagtaatgtaaactatgggtttagttaataataatatatcggccaggcgcagtggctcacgcctgtaatcctagcactttgggagacagaggtgggtggaaacacctgaggtcaggaattcgagaccagcctggccaacgtagtgaaaccccattgctactgaaatatacaaaaattagccaggtgtggtggcatgtgcctgtaatcccagctactaaggaggctgaggcaggagaatcgcttgaacccagggggtggaggttgcagtgagccaagatcacgcgactgcactccagcctgggcgacagggcaagactccgtctcaaataataatagtaataataataatagtaacatatcacattcatttatcacttgtcacaagtggaccacacaaatccaacatgctactaacagaggaagctggcagggaggggatgctgaggggtgctataagaactccatgtcctttctgttcaatttttctataaactttcaactgtactgaaaagaagaagcctattcattttttttaaagcccacagaggcatccaccagacacgtgtagcttctgtcttcctccttggtgactcacattttggccaggacataccccacaatcttcccattctcgtcctcagcaatgtaagagagctggtgacaggaaaacagagtgagaaaacttcttgtcggagctagaagagccctttagagggacacaaactggacgagtggcgagttgtgtgatggctcatgacctccgggctgagtggcttggtctccccctcgccacactgtgccctgcccatacccagaaagaagacgcaaagtggggatcctgcccctattctctgctcccttcgggcgccttcttttcctttgcccctgtctgccagctgaaaacacccaggacgccaccgaccatacagccccctgggctctgacagacttgtccactccctccaagatggccagatgggattttcctcggcctgctttcccccatgcccaaattcagaagctgcccacctggggccaggaaaggccatggtagaagtagtatttcatctggtagttctcgggcaggcagaggaggttgcagtgctgcatgttcattaggtcctctggctgcagggaaggagggcagtggaacgcgctcagtctaaggcggcggtgaccacgggtgagaagcctgctccccgtcggtctgctcggccccgctccctcggggctgggcaggcactgtgacgatctgactttgcacaacgcccggagcacaggaacaggagtgggcgccccggaggtccccggagcccacccaacggaggcccgacatcacgcaaacaggagggaatcgcagccccggccccgcgccccggcctcttcggcgggctgggccagccccataggtccagcggccgcaggcacactcagggccaccgggccgggctcggccggggccctcgggagcatgcgcggcagccacccggcccggcgcccacgcggcgcggacagcctcccgccccgggcgctcaccctcgcattgcggatgttcataacggcggcggggctcgcgggtcccagcggatcgtgaaggcgcagtcagctgccgccgcgctccgaagcgacgccgggacggccggggctgggaccggagctgggctcgctgggcgacggcggaaggggcggtgcgcgccgggccggccaccggccggaagtgcacggccgccgggcccgtcctcccggccgcttggccaatgcgcgggacaggccagcgcacggggcgggccaatgcgcggagccggtcagcgcggggcgggcctgggggcggggcgggcgctgccccggagctggagccggcccctccctcggcgcgacagcccccctcccgcgagcccacagacgcgcgcacagccgcaggtggagcggactcagcctttattccgcgcctcggcaggcgggggtgggggcgggggagggggcgggggcggggcggctcagcagggcgcccagcatctcctcgcacatggctaggcaccgcggcacgtggaagcagcctgcgggtagaggcgggcaggtagtgagggccgggggcagccgagaggcgcaacccctgcggccccgccctctcccccactcacctttgaaaggacctcccttgatggagagggccaccttgccctctcggctcaggtagccaaaccattccccgtactcgggatcgcgaaactggaataacagagacagtgacagctagcgcctgcaggacccgcccagatgccactgcatcgctaccaggggtcagagcctgggttgaccccaggtgacgtggctccagaaccagcgatcttaaccgcgacactgcgtcctccacaaagatgaaagcaggggtgggcgcagcaggcaggctacaactatataaccgactgggcaaggggatgagacactgctagatggaatgaaagaactctgccctggggtgtagaaacgttgtctatcgggccgggagctgtggcttgcgcctgtaatcccagcactttcggaggccgaggcgggcggatcacctgaggtcaggagttcaagatcagcctggacaacatggtgaaacctcatctctactaaaaatacaaaattagccggacgtggtggcacgcacttgtaatcccagcagtatactcgggaggctgaggcgggagaatagcttgaacacaggaggcggaggttgcagtgagctgagatcacgccattgcgctccagcctgggtgacagagcgagactccatctcaaacaaacaaacaaacgaacaaacaaacaaacaaaaaagttctctattgtgattgtagtcgtggttacgttgattcaaagaaacaaagaacccggccgggtgcaaaggctcacacctgtaatcccagcactttgggaggccgaggcgggcggatcacaaggtcaggagatcgagaccatcctggctaacacagtgaaatcccgtctctactaaaatacaaaaaattagccgggagtggtggcgggcacctgtagtcccagctactcgggaggctgaggcaggagaatggcgtgaacccgggaggcggagcttgcagtgagccaagatcgcgccactgcactccagcctgggcaacagagccagactccgtctcaaaaaaaaaaaaaaaaaaaggaaaagaaaagaaacaaagaaccctgatggaggcgacgacctgtcatgaaactcttaagaagtgactcccttggagctcccattcccggcttcacaggcctgtcttccagtagatgcacaatctcatctgactcctgtcctggctcaccattggtcccaaactcatctcctcctccctctgcccctgcccagtgcccattccactctctttccttctctctccactagcattccatggggcacctgtctcagggaggcttgtcagttcagccccttctcaaaaggatcatggactcaattacattgaagtccactatgaaaatgtctctttaaatggtggcccataagagttggtgtattcttctttgtaggaagtaaaactagtcctgggctgggcacagtggctcacgcctataatcccagcactttgagaggccgaggcgggaggatcacttgaggccaggagtttaagaccaggctgggaaacatagtgagaccccatctatacaaaaaaaaaattaaagaattagctgggcgtgatggcacacagctgtagtcccagctacctgggtggctgaggtggaaggatcgcttgagcccaggaggttgaggctgcactgagccatgattgtgccactgcactcagcctgggcgatagagaccctgtctcaaaaataaataaataaataaataaataaataaataaataaataaataaaaactagttctgtgtgtattcattctgtcttttgagttacattgttcaagtccttacttattttttgactgcttgacatgacacaggaaggtaaagaagaatttccttcaatgtctggatttttgccttctgtattctgttatgttggttgatgcataatgacttacctgtttttttgtttgttggttagttttttggtttttgtttttttaagacggagtttcgctcttgtcacccagactggatggagtgcagtggcgtgatcccagctcactgcaaccttcacctcccaggttccagtgattctcctgcttcagcctcctgagtagctgggattacaggcacccgccaccaagcccggctaatttatttatttattttttttattttttattttttttaatggagttttgctcctgttgcccaggctggagtgcttcccgggttcaagtgattctcctgcctcagtctccccagtagttgggattacaggcacccgccaccacacccggctaattttttgtatttttaatagagatgggggtttcaccatgtcagccaggctgttctcgaactcctgacctcaagtgatccacctgcctcggcctttcaaagtgctggaatggcaggcgtgagccaccgcgaccagcccaatttttgtatttttagtagagacggggtttcgccatgttgaccaggctggtccagaactcctgacctcaggtgatccacccgcctcagtctcccaaagtgctgagattacaggcatgagccaccatgcccagccgatttacctgttgattataacttttgtaattgtttaatgtcatctatatcttattaaaatgtattccttcaatttcatttttgagttagaactggtggcccctaacacacactctatgaatgcattaaatattaagatatagctgcaggtctaacaaccctgctgctttggaagtagtgacgaatatatgtgatacttgcagatgtctctctaactgcaatgcaatgtaaacacatctggatttctatcggtgacaaagccaggcacttctattaccaatgtggttcattgcctccactcataatggcagcaaatgctagtttcagttagaggttagtacaaataaagatgtgattctccgcccccggtttcgaagctcacagaccccagaataagatcccctgctatagtcctcgcagtaccagggttcaccagtggagtcggagtcgtggctttagaaacgcatgatgaatcttcattcattcaccacccaggccttgccaccactgggtgccatgccctttccactgggtgccatgccctttccactgggtgccatgccctttcctgtgttcagcagctcgagttgcctcctgggcagcagtcaagacagcttatcactctgctcctagcacttgggcttcagggagcccctggcttggttttcttcctgcgtcaccactgattcttgtctcctttgctgggcccccatttccctttttgcctcatagatctcagcagcatctgtactgtttttttttttttgttttttttttttttgagaccaagtcttgctcttgtcccccaggctggagtgcaatggtgcgatctcggctcactgcaacctctgcctcctgggttcaagcgattctcctgcctctgcctcccaagtagctgggattacaggcacccaccaccacgcttggctaatttttgtatttttagtagagatggggtttcaccatgttggccaggctggtcttgaactcctgacctcaggtgatccacctgcctcagtctcccaaagtgctgggattacaggcgtgagccaccgtgcccggccttttttttttgagacatagtctcgctctgttgcccagcccaggctggagtgcagtggtgtgatcataactcattgcagcctcaaactgggcttaagcagtcctcctgcctcagcctcctgagtagctaggactacaggtgtgcatgacacccagctaattttttaaaattttttgtagagaccaggtctcgttatgttgcccagactggttttgaagtcctcggttcaagcgatcctcccgtctcagcctgccaaagtgctaggattatagacatgagccactgtgccaggcagcatctacattcttgtgatactgaaaacattcatggtgagtccagatctctccgtctgaactggagactcaggaatcccactgctgctccaccagactgtgaaccctctgtccccaccagctcccacctgggccagccctcactggctgggatgacagctacagcttcctctgctgtcccagcttctgccctgttccctacagacttcccccataacaccctcccctccaagccccaggacccaggtaacaatggaatcagaccaggcagctggagtccgtcccttgcccactctgcctttatcctcccgggctgccaggcccccctgctgtgccacatgccccaccctgcccagactcccagtccctcagacacacccctgattgactcggcccctgctcagtgcttccctgctgccaccccataggaaagagcccccccacaaccctctccagtggtattattcccacagctgtcactctcaccaccacctaggtctgcttgcttacactctgctcctcccgcccccaccaccaaaattcgagctctaggagggcagaggcttcttcgttgactgaacgaacagcactggggctccggaaactctcagaccagctgagcgactgtgctcagcgagggggcaagagcgcagccgggccagactccccccattcccccattcagcctctagaggggacaaggaggcagctctcacctggcggaaggtgtactcagccacttggtagaagaggcgcagcagcacagggtccccactgtcactgtaacccatgaggaaggcaatcatggcttcactgtgtggccaccagagcttcatggcccactccagctgaggggagagcaggggcaggcatctcagcaggaaactcccctccgcaactttccagacctggctgcgtctccattggcccaagctactggaggtgaattgcgggacatctttggaagttctgaaggacccctcccagtgatatcagcttcctgacctgtagattcttgaatagacaccagggccccagacgaatggcatatatgtctgagcatcagcgtttcgccagctccctggtggcctccatatgacatggtgtcagaggtgtgtaaaccagagcaactccatcttaaacaggagctgggtcaaatgaggctgagacctactgggctgcattcccagacggctgaggcattctaagtcgcaggatgagatatgaggtcggcacaaaatacaggtcataaagaccttgctgataaaacaggttgcagtaaaggagccggccaaaacccaccaaaaccaaggtggcgacaacagtgacctctgctcgtcctcacttccaacagtttacaaatgccatggcaacgtcaggaagttaccctatatggtctaaaaaggggaggcatgaataatccaccccttgtttagcatatcatcaagaaataagcataaaaatgggcaaccagccgggtgcggtggctcacgcctataatcccagcactttgggaggctgaggcgggcggatcacctgaggtcgggagttcgagaccagcctgaccaacatggagaaaccccgtctctactaaaaatacaaaattagccaggcatggtggcccatgcctgtaatcctagctactcgggaggctagggcaggagaatcgcttgaacccgggaagcagaggttgtggtgagccgagatggcgccattgcactccagcctgggcagcaagagcaaaactccacctcaaaaaaaaaaaaaaaaaaaaaaaaaaaggcaaccagcagccctcagggctgctctgcctatggagtaaccattcttttattcctttactttcttaataaacttgctttcactttgcattgcggactcgccctgaattctttcttgggcaagatccaagaaccctccctcttctggggtctggatcacgacccctttcctgtaacactggcacagaagctgagagcaggcctctaggttccaatccagccccaggttaccctctagagaagcaaccacctccctgggcagaaagccttagaacagcgtgggtcacacatggccctgggcgctctcccacctgggtggggcagaagttatcagcatcctggaagtaaaagaggcctccgtggtcagggtcccatccggagtggaagggcaacaataggaacttgtcaatcacgtgggctcgaagttcggggtcgcctttccgaatgcaatgacggagcagaaaccagccggcttccagcgtgtggcctggtgaggggtggagtacggaagggcggggggcggggggtggggttgagggagggaacagagggagcaaaagcccctggcacctctctgctccctccctaacaatgagcgaggctctgagctccctggccctggaagcctgctcctctgcagaaacccccagccttgggaagcccatcctcgctcctctgcctcctcaaggcgcccccgccaggcactcccatatctgaagcccagaacacaaggctcagcgctcccctcctcctgggtggcccccagcccaccccgcccctcacctgggttctgctgtctccccaggcagccaggaagttccttgccaccctctgacacattctccagcacagcttgtccatccctctaccgggaaggagcagaagggaatgttgcctccagccctttcacccacccagccacccaactagaaagacccagctccggaaagcccttcctccctccctcttacccaagcccctggacctgctggcttgggtgggccaggctcagaggggcatttaaggaggggctgattcactcccttgggcctagcaagttgttgttttttttttttttttttttttttagacagagtcttgctctgtcacccaggctaaagtgcagtggccgcaatctcgactcactacaatctccacctcctgggttcatgcgattctcctgcctcagcctccctagaggctgggattacaggcatgcaccaccatgcccagctaatttttgtatttttagtagagacggggtttcactatattggccaggctggtctccaactcctgacctcaggtgatccgcccgcctcagcctcccaaactgctgggattacaggcacgagccaccgcgtccagcccgggcctaggaagatgtaatcctcacttctggcctgatcctctccagcaggggagggtgaaacattgaatggggacagacagggcgggtttcacggcccagaggcctggaagggacttgggtggggcaggaggggtctccttctgtcagggcttgcctggggctccgcatcctccctccagccctcaggccctccaccttccccaggtggggacatccccgaatctctgtctctccaggtgtgtcgagccccagggtgcccaggggagtgggggagtggaaggcctcccaccaccccagctccccaggcatcccccacctgcacgtgctgcagaatcctccgggcgcaccagtcccccagctctgcgtatttgcccgccagctcctcatctgcctccccgagctgctccaccaggttcagtagcatcatgggcaccgccatgggctccgcagccggggccccctggagctggggccggcccagtcccgacgcgtcctcctgcacccagtggacgatctgatccatcatctccaccgcttccgtctgggggtgcaggaggcaaggggaggcccaggctgaggctacatcctgtgccatccccctggacacggccctggggtgggagagccaattcctctcctgaacccagagacaccttcatccagggcctacttggggcctggcacccagcgtccagtaggggccagtcagatccgccccactctgctcccagtctgggggtgcagccccttccaggctgtggggtcagggtctggcagcacagggagcccagggaggagggaagggccttttcccagttgggggcagggcgtggatagggccctctccgtctgcgcccctgtgggggtaggggagcgttcagaggtgaaggggacttggcccacagatgggtccatgggaggggacttgcgtagtgagtgggaatgcatcaggtggccatggcagggtcgcagggtggggtcttcaggggcaccctcctctcacacacctggtaccgcacttcccctgtggctctccacagctcgttcatggccatggtgtagaaacactcactgaagatggttcgctgcaccttgaccgggcggccgtcccgagtcagcacaaaggcacacttcttgccaggaggtgccacccgggcataccgcagcaagaactcaccacctggaggttggggggttggcatgccaggggtaaggccaggacgccccgcacacaccacccttgagcctccccaagtccttcgctgcttctagatccctctaggaactccgcacatgtgccctgttgagtaaacatggacggagtcactgggagatgggcaggaagggggcacctacctgcttttgctgcgtccagaagctgagcatggcggaagcgctcgaaagtgcggtacaggcgacaatacatccatacctgcggggtacgggagggaaagtggcttaagtggccggctggggtgaggtggggagacctttgaggcgatgggccgtgtgcctgagcttccaggctgggaacaccatacctgcctcccctgcagccacacatacttgaggtcatcatacacccgcccctcgcggccaaggcacgtgaagaagcccctgtgggaaggcagggttagcaaagtctggaacgggccttgccagcccctcctgcccctctggggccagcaaatctgtgaggtgcctgagagtgagaaggggcctcaggaagggcaaaaaccctgctgaggactccagaagcacgccgagtacccgtgctcctggtcgtgggagtgctccatccagaaagccaccacgcggtccagctcctgccccacgcgctccttccaggcctgcagagtctctcgctctttctccatgtcctaggggaaatggggcttgaaggcgcagcccccacatgggacctaggcccccccagcctcgggaaccagccctcagggatctccccacctctgcacggggcttcagacgtcaccatccccgggaccctccaagacagcactccccccaagcaccccaccactggcctgtcgcgctgggagacccttgctcatccctcctgctcctctaggaagccagacagagttggtcgcggtcccgtgactgtcactcagctgacacagccgcgcccggctcaccctccccctcctcttcagggttccgctgggcctggggcggggctttgaggcccccgcacttgttcctgccgcgaccctccactcgaatgggccagtccctccagggcccctgctgggagctctggtctcaagatcctgcttggtgggaaaagctgggatggccggagggtctgggatgagggggaacggggctgccacccaccccgccctacaccaggggccccggcagggcggctgagggccttggccctaccaagcctgtggggcaggggtgcagcaggacagggaacagctagtgggcctgaatgcagaggtccctctgacctgtcaccacacagggtagacaggaggcaagttctgtttttgttgttgttgttgttgtttgtttctttgttttttgagacagtgtcctgtcgcccaggcagctcactgcagccttgacctgccaggctcaagcgatcctcccacctcagcctcctgagtaggtgggaccacaggtgtgggccaccatgcctggctaatttttgtatttttagtggagacagggttttgcaatgttgcccaggctggtctcgaactcctaagctcaagcgatcctcctgcgtcagcctcccaaagtgctgggattacaggcgtgagccaccgcacccagcctagcaagtcctctcttttgaatcagtttgtcaccaactacctcaacagtcagtaatgggcagccattggcgctaattttttttttttttttcccaagatggggtcttgctctgtcgcccaggctggagtgcagtggcatgatcttggctcactataacctccgcttcccgggtttaagcaattctcctgcctcggcctctggagtagctgggattacaggtgcctgccaccatgcctagctaattttttttttttttttttttttttttttagtagacggtttttcaccatgttggccaggctggtctcaaattcttgacctcgtgatccacctgcctcggcctcccaaagtgttggtattacaggtgtgagccaccgcgctcggccttggcactgacttctttacacaagtgacacagctctaaggccagacagtaactgcaggtaacagcccacaccccccttctctgggcctgttttccagctgcccagatctgtctgtagctctatgactgacccgatgatgctacaaggcagctgggctgaggtggttcctaccttccaggccaacagtgcacaaaatgggttccagcctctgggcgtgggtactgcactgctggtctttgatgccacagtggctgtctcagtccctgctgcaggctgacccacccaaccccaaacagttcccctttggggtgcttggtaatgaggctgatgccctggcagctggggaggcatcctctgtgtgctcccacccaccctcggcctcggctcatgctcaggggatgagctttgtgcccagccgggctgtatctacctgccctgctcacaggcctgtcatgttcacattcatgtccagcctccctcctgcctccccagactgagtggtgccctcagacggaaacgcggtattttcagataaacaccagaggcatgactgatgtggcccttgccttgtggagtgtgatgcagccgcggtgagacaagtgagctgaaggaatgcggagggtgggtagccccacaggtgccagctacagaagtggggtaggaagaagccttgtaccacccccaccaggcgaagcgcccacaacgccatttgccaaaggtatggcaaatccgcaaggcccctcggttctggggccagccccatgtggcccctggcctccaccagccccagccatgactcctaccgctctgctctgaaggacactttcccacccctctccttgggcctctgcgaggctaggctccaaggcaggtcacagttggtgcggtgggtaagacagagccatggctcctggtgtcaagccctggccagtctgcttccccccacccccacatgacacagcagaccccacaggacagaggcttcccagaagaggtcgcattcgacagggccttgcacacacacccatgccacaggtggagacacggaggctttggttactccaggagcttctggtagcggagtgcctgggtgctctgagaggaaggctgggcagtagaggtgtgtaggggaaacaaaggcaggcggcaggggcttggagggggcggggaatgcaggtgcgccaggagcaccaggccccagaagcagggtgtcactcccctcagacccgcctaggcctgtgctgctccggccaccttgccccggagctttctgggcctcctggtacaaattcagcccacgggatcccagctgtcctaccgacccagctgctaggtggtcagtctggatcacaagctcttgcttcttcccttgggggcatggctcacatttaagaggaagccagaggaagggatccacctctgcagtacccgtggtgtacttgactcagcccacctccccccaacccacccaaggaggctgccgctggtgacctgccaggcccttgccccatcctatcctctagtgcaggaggggagggagggagatctgggccccagacacaggaagtcagcagcagctgcccaaggggctctttggcccttgccctgcaaggcagctaccaagcaacctgctggaccctggtccgacttggtccaaagaccggaggccacagcagaggcctcactctggggccttctacgctttcaccagagctcaggtctccctccagggggctcccgtgagcctcgggcaggtctcagccttcccgctcaggcttcctgagaggatgccgggacacagtgagacacctagtggttatttcaaaaaaagtcttttaattgttcaaaatagcacaaaacgacatcgcactatggtaatattgagtcacaggggttactctacaatagtgaacggtgtactctcctcagaaacaaatcaataggcgcgcgagagaagggatggggtaaaacaacaggaccaggtgagtgggctccaaggtgactaaacgtgacattttccacagcgaaatatactataatacaacaaaccagaggccctggaggacacaggctgctgcgtctccaggcagaggtcggtaggggagggctggaaagattggctgctcggttcaaatccttctgacttgctggcaagccttgctcctcgacagaagtttggggtggggggcagaaaactccaagcagatcccccagcctcggagcctggcctgagttccatgctgcacagctgctgctggtggcctgctccattgccctagcctcccttgtgggtgacactacacagtcaccctcccaagctgcctccaaggacgcctggttcccctccattctccaccctttccatgacgatttgggggaggtggagcagtggctgcggaaaccagcagccctgtttgggaggcggtgccggtggtgctcagggagggggcatggggagagctggaaatccaggacaaggaggccccagccctccctcaagctcccctaggctcgaccctatagatgcggagtgatcgcccatgaggaatgagctgtccttcctttgttccagcggcctgaggacaggcaaaagggcagagggcaggggccagcaacaggaagttgggctgggtggcaaacagcaggcccctcgtggcagatttcacacctctcctgccctggctggccccagcttttcctccagaaagatccctgccaagaattagccaagaagaaaaaagtaaaaaaacaaaaacaaaacaaaacaaaacaaaaaaaagagaaaagaaaaaagattacacattctgtacacagctaacaacaacaaaaaagggacaaaaccccacacgctaaaattacaatgaaagtgtgaacttcaccaattgcaacctaaaaaacacaacaaatgcagcagttggcagtgcggcctgcagggaggtctgcacaggcgctgcccaggccgccgcggggctccttgccccttttttctttttccttcttttcttttttaaaatgggaaagaagagggggagggtagaagaggtgggagcacaaaggcctctgagaaaatgtgtaagcttcctgtggggtcactgagcagggtgggccgggggagcctgaggaagggaagttaggtgactggaaacacaaggggaagaaaagaaaacagaaccagacacccaggccagggtgccaggaaagccactctggggagggccaagagggacgcctttcctcccctccatgcctgcccccgacctggccctcaggaacgcacagccttgggagggcggagctggctgtcctcagctccgccttccctccccgcaaaagtctctccccagggtgggcggcagcggggaggaaaggaagcgcgctcctctctctgctttcccatctgcctctgcttcctcccaacagcaatggtaaaatgtgctttctttagattattttaaaaacagagagaaagagaaaggggagaggagtgaacagcggctcgcgagggtgaagtgcgaatgctgggacggggtgggaggggtgggccctggcgggtgttcctgaagcaggggggtctggagaagaatccaggggctagtcagcttcctctcactgaccatcggccttagatttctttggagcagatttccttggaaggcagaaaaaggaaagagaaagttagtgtgggccctgcaccactggaggccctgctggtgcagggccggttaggggcccccagtcatttgacaagaggctgaacccagctatttccacccctagtctcagaaggttcccgagaggggcttcctgcttacatttctggagaggacatgggccgcttgttggctggcttggtgccagagctgtctttactggtttctggaaggaacgggagagatgcgtgagcagcattgtgacagaacgagagcaaggaacacatgcgccctgcccgcctgcagagtctcttggtgccacatggcatgacccgcagctggcaagggtggggcgcctgccctatgggtggtcaccttttacgccactccttgggaccagaacacgacaccactcactcccctctggacgtaggttagaaacccactcagctcagctcccacctctcactgccctcccaggtcccagagccccaggggagctggagcaggagcatgacctgacaggaggcaggctggcctccatccctcacctgctgcactccagggacctgggacgtgctgttttcgggcctggaaacctacactttcccgccagccctctcactgcttgtcccctcaaacatcctggggtggcgtcccctgcacccccaggcccggagctgggtcccctgctctacttgatggccacccccgtggggggctgtgtgcgcgccaaaggaagcagggagacgccgcacatgggaaaaaatctcagatggtgacagttcctcctgctgcacccggcttcctgggccttccctgtgcctgaagagctccacgaaggacactcaccctgcagccacctcacttgtgtggccgggccatagcccttctcattgcgggcggcgatgcggaagatgatggcgggcttggtggtgtagtcgatgtgggcgttggaaaggctggaggactgcaccaggcaggaggggctgggcccgcagtacacccgcatgaaggccagctgggccggggtggagctcttgagctcgcccccagcctgtgagctctggatggccaggtacacggagtactcgataatcttgccggaggtcacagagggtggctcccaggtgaggtgagcaccatccggactctagaagccagggggtcagaaggtcaacagaacaggctagaggcttccagaactgactaatcatggttcccataagccattttctaacacagtagagatattccatgtggtagttcaaggagcttcaaagagatcttcccccaagtggaaggactaagacaaactgggactcaaaacctagctctcctatgcccccccccggccacctcatgtgctgaggcaggcagaaaccaaccagggacagacggccaccccacagcaagactcactttgctgattttaatggcacaaggggcccctgggaaaccaggcaggcacgtcttaaaggctgagatttcgctgaagggcccccggccacaggcattgattccggcaacacgaaacttataggctgtgcctggctgcagctcctgcttcttcagctggttatagtcagggacggtgcccaaatcatcctaggaaaagaggagtggcatgaacgccactgtggagaaggcagctctgggccaccccaggaacactgcaggtccatggtaactatgggccagagggaaaagaggtcagcggtggctggcccctcacggcaaggagggacgtggcgaggctgactgtggcccggtactggcgggaaggaaccaaagctctccttttctactgcttcaggggggatggtctctgcccaccttcctcaggcttcctggctactcagcttggcccaaagatggaggagtttcctgtaagccccgctcagggtggtggagccaagacccacccacctgaggacatcagcacctggggacacttacgtctgatgggacagcatcatctggtggcaggaaatagtgtgtcaccattacattggtgcccttaatgactcccacatcaaaccactggttttccttcttcatgggggctttgctgggtgggggcggcaggtctggcttctgcaagacagaatcggtgcgacgagatcaggccctcagcacctagaggcagtgctgccccccaggccacggactcaggagccccaacacacccgactcaccacacccagggactcgatgccattggccacttcggtcagggtagctgcagcctgcagcttggctgggctggccaccacaaccggctggggggccacaaatgtgttggatggagccaggcctaggaagaaagaaggtgtcagcgggaaagactcgggaaacctggctcccaagtgagaccgagcctcccgtcctgccctcacctccctgggtgcccccaccaccccagcaccaattcgccctcagtcgcttactctcagtggccgttgagggcagcagcgccacagtgctggggaccgtgccggccagctcattgaggcaattgctctcaatggctgggtcgttgagactgtcggcaggggccagggcctcagtggggaggtggtgatgctgctgctgggcctgggcctcctgcagctgctgctgctgcaccagggcagccagctcctgctgtgtcagcacaatgggtatggtggtggcctggccctcctgaccctcggccgacaggtgccccagctccgcctgagtcacggttgctgctgcctcggaggtgtccatgggctcgccggtgcctgctccagggtcgagagaaacactacttactaggaaggctggccagaagcgggcagcccgggcggaggcccccaaagcctgtcctagagaccccgtccacctcctaccgtgctccactgtaggctaagccctggccgaggggccctgcctgtttcccaggcgctaaccccagccagcctgttctacacggcagtctctactacttggcctgcctggggtcccctgtgctcgtcctccccatcacatctggctcatgccaccctcgagggaaatgggctcctcttcccaggctgtctccgcggcctattgctcccccgagcggcccggcttccccagggttgcaccggcactcacccatgacggcctgctgcgcggcctggagcaccgcctggatggccagggcctgggcttcctccgtggctgcggcctgggcagctgcttctgcagcagccgtcactgccagctcctcgggggtgagccccgttaccatgagggtggtggtgccagcttgggcctcggccattagctcttggggaagtgataactggtctacttcggactgtgtgggtgggggtggctggaccaccacagtggccaccaccgcagagccggcagactcctggcccgaagatggctcccctgtgctgctcagatccacggcggccgggagctcaggggtctgggaggctgacaggacctcggcggactcccccatcagggctgtggaagccgactgcagaagctgccgtggcggcagctgctggcgaggacctggcgacacctggagttcctctgggggctgcaggatgtcaacagcagagaagggcatgtcagaagtttctgtgttggctatggtcactgttattttggccgggatggggacttcagtagtcagagcccttggggcagtctcagtcattgatgagatcttctagaaagggagagaagcccctgtcagaggggaggagaggggccagagccaggcagcagggctgagaagcaagccagccctcacctttccttgtgggcctaagttttcattcttgatgggccagctccagcccatgttaaatagggaggggacagtggttctctgaccagcatgaggagaaaggcccttgagacccccggtcaggtttaacccgtcctcagtcaccctggcctggacaaatgggcactcagacccccgccatgtcttatacaggctgcggtgaagtgacacgcgatgagaaccagtcccagaaataaaagcgccccagagatgcgggggacggtgaggctcctgcctcctgccgcagcaggcaccgaggctgcccttttatggtccggaaaagggaccaggagcggccccatgcctggtacaagagcgacatctggcgtctgagtgtggaactgcacgggcgtaggccgggaaggcggggaagaacacggccccctgggctcttaccggcacagaggggcccgggaccggtgtggactgcgtcacggtggtcacagcccgcgtcagtgtggaggacacggttgtcgtgatggcactggagctggtgatgttcacgctgtcgccctgggtgctctccacctctccctgatcgctggcagcaggtggggggtctgtgggggcgacaggcaggcggctgctcagcaggagcccccccggcctgtacttggcttgaccaccacaggcttcctctaccaccaaggggagggccagataaggcaggacaggctcctggagacctctgtctgcttcaggtacagccaggacgccccagctctccccactggtaaattgggtgccaaggagcctgactggtggactctggacggacccccgccatcgttgtcttggcctttcagcctggggggctgggagaccatgaaagccaggctggccaccttcacttaccttggtttgaactcatgttggaagtgacagtggtggccgtgtgagtggtgcccgtctcgtgggtctcacagggggggttggagcacaccctctgtgttgggaaaggagccagcagcgcggtgccagcctggggggtgacgctgggtgccgccgccacctctaggccagactccacggtcctgtgggaagaagtggcgtcgggaagcagggcacccacgctgaccgacatggtggtgccagtggaagtggtctggtgtgtctcacaggggcgaccagcagggggctgctgcccaccctcgggctggcccgtgcccccgtttgaagtagcggtggtggccgtgtgggtggtgcccgtctcgtgggtctcgcatggcgggttggagcacaccctctgggcgctgcctgcattcgaggtagtggcggtgttggtggtgcctgtctcgtgggtctcacatggtgggttggagcagacttgggtcacggtggccgaggggcacagcagtgcctccagggctgtcacagtcactgtggtgctgggcgagccaccctggaggctctcgcacacaggtgccatgcggggctccccagcacccacgctggaacgggtcatggcagcggtgctgaccgcatggctgtggcgccccgcaggaaggtccttaatgcttgggctgctcagcctgactttgctgctcagaggggccaactgcacaaaagcagggctgcggcccccgggctcccgtgccatgctcggcccaaggagtgggccggccgagcacggggccccggtggccatcacagtcatggtggtgctggtcgcgctggtctggcgggtttggcactgggacttagagccctgggctgcctccagcgccccagtggccacactgatccggatcacggcaggggtgccagctgcacaggcccgacgggcatctcgctggtggttggcgccgacgctcgacatggctgtagtggcagtgttggtggtgcccgtctcgtgggtctcgcagggtgggtttgagcagccatgctgcccggccatgttggaggtggcggtggtggcggtgttggtggtgcccgtctcgtgggtctcgcagggcgggttcgaacagactcggaccacgctaccattctgctggcccacagtcgaggtcacaagagaagcagctgcctcctgtctgtcacagacgaactgcacttgggtgggctgggggtgtcccccaaggttagccacaacagtagtggtggccgtgttggtggtgccagtctcgtgggtctcacagggtgggttggagcacaccaaggtgacagtgccaggctgcacatcaccctggcctgagtcggcgatggtaactgtggcggtgggctgttctgtagtcggggaggccagaatggacacagggaggtcatgcacaggctgggcctccaccccactaggtgccgtgatcagagttacctgggtgggctgggacacgggctggggagacacacgaggaggagagttagtgctgcagctggctgtctgcctgtccctcccactgtcctgcactgtcaccacacaggctgggaccactgaccacttctcaacggccctggcagacgtaagacccactcacccctgcccccaagacactgacttgctcagaggccagggaagaggcaccactttgcctcaaaggcaactgggatgaggaagaggctgtgaggacagggcaaggggaaggcaggaggctggctgaagtcaagtcctttgtcagagaatggaaatccccctcaatgctcaaaggccaacaacaaacgtttcaccgttttccttaatatgtatgaacagaacactgcacacacatgcagacgagctgcggcgtcctgtagaacactgcgagaggaagaacccggtgttcaaacaccaggcatggccaaaccatgacagccaaaccacggactatgacacagggaccatgtgacaccagggaaaatgccccaggtgaggaaaggcctgccatggctgcacccggcagcagcgcaacaccaggaaggaaaggcctgtggacggacggcgtgagcctcacgtgcttccacttgtgtggggtccctcgcccacacgtggcctcaggccctgccctacctgcatggtgatggttggggttgtgagcccgcctgccgctgtcagcgtggtctgtgcggccgacacagtgatggcagtggggttgatcacctggcttgagagggtggcaatggtgcccaaggtggtgatgggcgtggccagggaagcactagtgctgtggccccccgccccggcaaggctggtggagacggtgcctgtcactgtgcctagggtcgtgacacctgaaggaaaggaggcaagagttgggccaaggctgctgctgtctccttcccagcagctcctcctgcacaggctggggcactctggagctgcttgcatagaaggctcgggagagaggagctgctgtgccacccagctgtgccatggggattgaaggccagccctgcttcgttataatctaggggtggcaggggacctggcctatgggtacacacctgtggtgcctttcacaaccaacgtggtgacggctggcttgacggcggagacggtgacgggtgtgaccaggcgaacaccccccatgggcacagtgcggaggatggtgcctggctgtcccggggcccccttaagcaccacctggaacaccagaggaaagtgccaccaacgtcaccaccaggctggtagatgccaccgatgctgcccctcccaggcctgtcgggaggacctgcgtggcgtgctggggtggactgcactaggacactgggctgagagacggctgggagtgcctcacctgggtcactccctgctgcccgtggccagtggcaattttggggacagcagtgatgattttcgcaggtgctccagttcctgaagtcatcaccttggtggtgatgatggtgatgggggacttgatgccaggactgctggtcacacctggatgggagagtggggcccaggggagacaggctctgtgagggctgcccctgctgcccctagactataatgaacatccacaagtcacagccatagccctgcccatctcctcactacccttagacacaaaaggcagcaaggagaagatagaaaagggtaaactaaacagaaacacagcacgccttataacccggactccatttcccctccagtgaggacttgcagacactcatatgtcgggggaggcccctacccgtggcgcccgcctgggtgatgatggccgacatggggatggttttgatgatggtggtcgtgccgggcttggtggtactgggggagacgctgctgatgcccaggatggtgggcttggtccccgccccactggcctgcgtggtagtgatgatggtggtgggcttgccatctgctgaggtcaccagcttcaggattgttcccgctggcaggggccctttggtctgaaagggggaagcaggtgcatgagccggcatcactgccaggaagggaagtgtggtctggctactctccgccggcagccttggcggctcagggaatgttctggaggctgtgggcgaggggagtgagcagcagaacttgctgagccatgtgtgctcatgggatcttccatgggcagggacatgagttcttcctgtggcctggcacccaggcccccactcttgcgtatgtgcaaagactgagagctcacctggatgatctgagtcacaggacccgtggacgcctggcctgtgactgctgaagtctgaactggtttggtctggaccaccgacatcactttgcccagattggaaatctaaaaaggaagggatggagcaaggagtgatctggaaaccaaacaagggcatggcctggctgagactctcctggagctggcccagggcggccattcaccactggcagtggccgtagcctggcagcacccatcactcaccagagcactgcctcctgggacagagatggggctcttcaccagggtgatggtcttggtgaccccgcccacaactgtggtcaccacctgggcttgctgggccactgtcacagtgcctgacttgtgcactgtgatgatagggcgggtagacgtgttggtggcggaggaaaccgatgtccccacctgggcggctgcagtcttcagcatgcgagtggcagggttgctcacctggaggaggcagagacgagtgacaggccaggcaaagaaagcgatggggaaaccacccaagatgtccacggtgggcccatagctcctgcctcaacactcaccttcctcctcctcctgctcccaagcccaagaacagcttggttcccccttcctttaacaggcaagggaggaggctgagcctgcagctctcacctgaggccatgacgcccctaatggagacagcttattctgcagcccacggtccaacggctaactctaaagcccggagggaatgactatgcttgtttgaccacagtgacaagccccggaagacgctcaccatgactggcgaggaggccaccttcacagtggctgggagggtggtagtgccaggtgtcacagccatggtcttcacgatggtggtacccgctgggacactcagcaccgtgggtgccgaggaaggggggatcttctgggtggcagcggccgcagcggccagtgcggccatcccactcatctgtgggctactgccaatcacctgcagcaggcacgggcatgtgaggccaggtcacaggtgccacccacctccctgcttggtggacctcaccggaacctgcccaggggctgccctgctcttgggagcctcatcccgccagcatggctcagctttctctactgccagaccccgctctcctggccccagacacagagggctcccaccacccaccatgcacggcaacccccgtggcaagaggcagctgggagctctggatcctttctaaagaccagagtcaggtcccgttgattctcatgggcctgtggcaagcccagctggctagatcctcctctcaggctgcaggacaagaaagtccacgtggcaaatgctcttaggatcaggcagcaggttaggccttctaggcattaacctattaattcccaccatgacctcgcaggagcgtttccccatctgcacgtcccaggagggaaaggtgtggggtgcgtggtaccagagcccgagagggatgtgaacccctcagtacacttgcaacttaatccactggatcaacaggaaatcccacccgccccagtgaccactcctcaccgttccctgggcactctgtgttggcacaaccatccgcactccggcgggaagggaggtcacggtgacaggggctttcccagcctggctggcaggtcgcatggtgaccaatggagttcctgttgtagcctgaggaccggtcactttgagaacagcagggacacctgatgagagaaggggccagccgtcagccatcaccttctgcacgatgtccccagcccctttgcaggcagccctgagccacttctgttggcctgcttgtgtgggagtctggctcttctctgtgccctgagagtgaccatttccacaggtggggccaggctttagcatccccctacaacccttggagacaagcccaaagctcccggctgctggcctgctgtctaggctgccgtctcgcagcccctacttggccgctgcctctccccggaggctagccccctactttcaaacgtccctggtcccctggctcaccttgagtcctggctgcggtgggcacagaaatggagctgccaggcaccgttggcaagacctggatggtggtggtggtcgggggtgcgggggcagcctggggcaggagcgtgatgcctacttgggtcagcggctgcacagcaggtgcggctgctgctggggcagggctcttgggagggttggcaggcacagatgggaccggattgggtgtaggggaggtggcagtagcagccgtggcaggaatgtcatatttctggagctggagaaggtagctgtcggctgttgccactgccccccagctcacctccagggagttggtgttggcgcgtaccagttgtactcgggctgggggtggtggcttttctgtgggagaacgcagttggtgagaaggggcgggaggctatgggaggaggggagtcggctgggccgggcctacctgtctctaggtaccagaggtccttgcagcagacctggttgttccaggccttgcggtagccgtcacgcccactccaaatgtacaggcgggtgttgatggcgactgcgcagtggccagcccgagcacgggggatgttgtcctccagtgtatccatcaggatggtctcccaggccatggtatctgggggagggcagacaagggaggtcagcaaggaggatggaggaaacccgccacccctggttgcccttggttcttttgttgtcaaggatgggaattaaaatcaagaagttattggattattacattaaaaacaacaaaacaaagaaaccctttgtggcaaaaagcaacacaaaaaataaaattacaaaccaccaacggccaactaagaaaaccatgagaaacacagtcagaggtttacctccttgcccgttaaagaacactacaactcacagaaagagacggcaatgggaaagtggtttagggaaaacgtgatagaaagatcttaagaaaaaacacacactctcacgcaaaagaaatctaaacttcaaccatcggcgcctggcatttttattttcaggcccgcagcagctggggctcaaggtgagccggagggggagcttcggccacccatcaggcttggcaaagagtggcctgaccattccgtgagggcaccactggaggcgcctacgtgggcacagcctctgtgcagggcagttcagccgcatcggacagcaaccctacttctaggttttcacccctaggatacacttgcacacgggtggagatggtgcaaggatactcacggagcggcgcctgtacaagttacagcagcacaaccgcaactcgaaggaggctgctgcggggcagggacgtggagtgatctccaagatacggcggatgagaaaggccaggtgtggcactgcgtgcgccaggctgccactgtttgtttttaaagggacctatggctaatgctcagatatgaagagcccctgcagggtggacaggaaaccacccacatggctgcctctgagaagcagaaccggagaaccgggaggagggaaggaggccctgcaccgtagaggcttttgcacttttggatgttgggccatttggatggagagctcattcaaaaaactcagaggcggaacattgcttcagagagctctgcccactggatccttccagtggattccaaagggagccgggggcccagcttgctccccgcacaccccacacagctcttaggctgagaagggccagcctcctgcagcctcccacaggccactcggagcccgaggaggccatacccaggttgagacaagccagcgtgttggtacacttccactccttctcgtgtgtggccactttgacgtcatccatgacgagaggcacccagccaccaaacacgtacattctgggagtgaggagggaagagtgggaaaggattgtagagttggtgccaagctagaggccacctctgctaccccagttctagagctcagtcctctggctctccccaggagagtccccaaggatgcgtgaagcctcctgacgtggccctctcctgcctggtggctcagccctcaggagaactgtgtcacctctaccacataaaagtgccgttcagctcatctaaagctcaccttcatgtccacagtttctaggttccctttaggacctggacatccacaaagacacccaggtgcttgcacagaggacctagaacactctgtacctgatagggcggagcctcacaggcccggggagggtctcagactcagcttgtgtgtggccctctcccccctgaatctgtctttccttggtcccccagggtcgtaatggaaaaacagggctgccaaatgccagcccagccagaaagaggcatcctcaggccttagggtctgacaggacaaaactgagtgagagcccttcgggggaggggccacgccagtctagagaagagagacgcaggtgagcagccacttacttatttccgatggtggttgccgagtggagactgcgaggaagaggcgccaccccgctgagactgggcttattccacgtcagggtgtctgcagagagacggaggggaaagggttacacaaggtagactgcacacaggtcgttccctggattcaagctagctcaggaaggtaggatctgtctcagtgagagaattccatccctggcttccctatagcctacggcaggccctctgactgttgtcatggtagctagattcctgtgttacccaggcggtttcgaccaggctagcaatagcgctccttcaggtacatcctgagcacctgccctgagccaggactgcactctgtgctgggggaggagtggtgggcacaccccgaactctccatgaaatacgttcaccgccataaccaccttaggctacagacattttggcaaactgttggaaaattctctcacgggaaactgcttctttggagtgccgactctgatctataggacaacatcgccatctcctctctcccagctgaagaggcctccggagatccacagttagtaatctttcccagccactcctgataccaccacctggtgaccggcccaagcagtccccgaaggcctcacggtttaccggcatccaatggtaccacagcagtcagaccaggatgcagcactccacacagtctgaccactgacgagtcaagagggactaatgctacccggatccagagaattccattctagaaagccttaatgacttattctcttataagcccgcagaccaattcagcccactcagccagcacagggcagagataacagccccaaacctagggacgatccagggttccccaccctggcccaccatgacaagaggaaagcacgaagtggtatgctccagctccctaagagccccacctcaccatacaacagcgccacccacggggccagccaagaggcagacccgctttgtcccatggctgctggggtgctaccaccctgctcaccaatatctagggtccacaggtcccccagcctgcagccactcatcccgccgtagatcaccagcttggacttcttattgtctttttcggtgtagaccacggcagtatgtgactcccggggtggtggtaggaccccgtaagtgatgggaatgtcccaggctaccactccagagcctggccgtaattccaggatatataagtcattcaggtacctgacgaggaaagatcagttacggcaagtctcgactcctcacgccagaggcttcgctggatggctatcagtgagtggcagcctccccagaacacaaaggggctagggctgtgggagctctgaagttcttctaccctagctcttgaggaaggggctgccagaagctccctaggatgagtccaactggaacaggggacacagggtgggtgaggctgcacagcagccccgagtccagacccagcagcaggcccccgccatgcacacaaagctgggtattatatgagggctccgcagagcaagagggggcgctggcttgggactacctccagacagagagtccttggccacgggccttggaaaatacccatcaggaaacttgtaggcagcggaggctgagaaggaacgcgagcagctctaagccgactccgagagctgggccagcccaaggcaaagtggcttccacctccagcttggccctcctcccacgaggcctgctcagggtcagtagcgattttggagcccgaaagctcctgagagggcatccggtgccgctctctcatttacaacccagcacgagaaagggacccggccacggggctctgctgcgcacattctttaggacaccatggagccctgtgcatgtgagagcacacccacccggggggttccagagaaaaggaccaagcctcaccttggaatgttgttctttgggtcctcgctatcattggccagacccccaaacaggtagcatttgttgcccacaagggagaagctgtgcccgagtcgaggacacggagggggcccgtttttgggcgtctttgctttgagtctcttccactcccaccggctcgcctgcaaaatcaagacctggagactgaaccgtgggatgagaaggccaccactagggacccggggcaacttgtggtggaggaggaaatggccgggggtgagcgaggtgccttgctggagcaagaaggtcctgggtgttggtccttgctgccttcttctgaggtgggccaagttcagagcagccttggcagactctcaagcgtcccttccacctcccgcttgcctcaaccctgaagccactaccgtcaggtcacatggggccaaggaggcagagtgagaacctggggctgctttacctggagttcgtagaggtcattgctgtatttcccatactccaccatcccaccaaacaccaggaggcgagtcccgtcacacacgaagccataggctgcacacccagggggaatgtcccccctcacggctgggatgaaccactggttggttgctggggaacagaaggaggcagaagtcagaacacccgggagcccccattcctctcattccccaaatgtgccagccgtcaagcttggtgagaggggctgagccagcaccatccctgcgggcgctctagcaactccagctgcgctacctgggccatcttccaaacccctcgacttcaggccagtgcaaaagagcctgtgaccaccctgcttctcgccaaggtcatcttaatgagcgggaagttactgtgcaagatccctcatcagctactgggaatctagccactgccttccttccctagcactcagtgatcagacatgaatttctccccaaaataccctcttggtgggcctgtgctcctcctccctggagcccacatttttgtcccttcatcacagggtcaggacagccagagcccagagcagcactttcaagtggccaaaacagtgaccgctgcaggctacgaagagccatggggatgagacccggcctctgctctgacctcccggacttcctctggtctcctaggtgatggtccaccagcatccctccctgcccctgctgccacacctatggtactccagaacattcttgcaagccagaggcagcagtctcagcagagctgtgacagaagcttctcaaaagctcatgagggtgaggcgaccaccaagaaagagggaaatcagaccttaggcactgctttgcttccacaggatggcacagcagccttcagctgggaccaggcccctccctcatgtcctcaaacttgactcccctcacacctggcaggccagggcttccccgaaaacctcctcctatgaggggtccctcagaggattcaccacactctttccagaaaccccaaactgggggccaggtgcaaccccgactctgtgcctctgagctggcctgggtgagatctcagcaagcagacggcagaaggaactgaggcccctccacatgactcaagacgcaagatgggtcccccaggacgtgacagggcatggggggattcctgtggggtgggaaggcttccacacagggatgctgtgatattgtgatataatacagactattcagtttggtggccaaaagtgttgtgagaccatagaagaggaaaaacagtgttttttttccatattcaggtgtgcacccagggccaggcggctgaccatggttgggaatgcatgccccactgcactctggtcccacccagtctcacactgtcacccccagggctcaatgcggaaccgtgtgcaaggctagcccttatccaaagcacaactcccagcctgggtagcacagggagaccccgtctctacaaataattttaaaacactggctcagtgtggtggcatacacttgtggtcctagctactcaggaggctgaggcgggaggactgcctgaccctcagagtttgaggctgcagtgagctgagaccgcaccactgcatcccggcctgggcaacagagcaagacctaacctcaaaacaaacaaacaaacaaaaaaaacagaaaaccccacacagcacaactgtaccaccaccgctcctcctgaggcgagagcacccccaccccgctctccagcacccactctgcgggtaggcttcgagcaggctgacagcctctgcagccattcagctgagtcactgggcctcggacatgccgagcactagagctcccctgccatttccctaaagcagagggacaacacctgtgccgcccgcatgtgcaagctcggatcctggccctctgcctctttctcattcccagtgcaaaaaccaccccagaaaagcaagagctgccaaggccaacagccttgcgcactggagagccgtcctgaccaatccctggagggagctccatgcaagctaccagggtaaacgcataacgagacctaaggctgcctgggccaactgctctcggtaggtaaaggggcagagcccaggagggcaagcgacacctgaggtcacagcgtaaaacagagacagagacaacagccccatcactgacttgaagcaaccgatctgtgccttccctagggtcccatgtccaggcagccaccctcactcccctgagcaccctcgtggtcaaagcccacagctatggggctgcgggtcagagtttgggacaaagctaaatggcacgtggggtcagtgggcagctttcctatcacacgctgatcagtgagccggtgggccaggccagaagcgccctgtgatatctttggggatcccgctcaccagatccttctacaggacccaagaggtgctgatctcattctagaacactccaggcagggcaggggccctccccacccccgtcaagagaggtctgtcagggagcacagctcctggtgtgacgacaaacctgcggctcctcatctcacccacgagtcctggttccgccccctgaaagcacacgagcaagctctcctcccttctcccagcttttcaatgtgacagctgctctcagtcacccctgaatcatctggggggtgtcatgtaacccaatccttgggcccctcatcctggaaatgctggctctcagctgggaggggaaggtggggaaaggaccctgcactagatgaagaccactccagctcccctctcctgagcaaggctgtgccccggcctctctgtgtttcatcagctcccccaaccacttcatgctctgcaagctccatccctggttgccactgtcccatcaccacctagagactggtgcccatgcagtgaggtggccggtcaagttcaacgagctgccttcctctctgttctacctgtcacattagagcatttcctgtgtggcatacgacgtgctgggaggcacagaggacaccgatcttgtgctcatactcccaatggggtaggaaggctgcatgcccccctcccacgatgagacaaacaccctagaagagctctgaccaagccgggcccttgggagcacagagcagtgcgactgctggagaggggaggacaggagtggaaagggcttctcagaagaggtgacgtttcagccgggccttgaagggtgaacaggatttcccgacaaatgaaactagcagggccaatcaggaagtgactgcaagagtctagtaagaggagaggagggcttggtgtggaaggggacacatttgatgcctgcccaacgcaatgaacaattagatacagggacagaggagagaatggaggcatttcaaaggtgatgggccccaaagacaggtggcagaacggcctctatgaaggtttgcactcccgcccaactccgccaccagctgggagggcgaccctggacctgtcacttcccctcttggaccccaatttcctcatctgcagaaacaaggaagtagttccactaggtattttccaaggctccctccagctccaagaacctatggacattacagagccaccgtagccaaagctctcgctcccccaccccccacacctggcagcactctgaatcctttggcttgccacatggaactaaaattccctaaggacaagcacagtagctaccctaagagctctcaaagcacacaccccctgaagctttcttatcctagcaacgggaaccccttccagatcagctctctccaaaggtacaaggctttttgaggactgatcccgcagaactgcaaggggcacaggcgtgagaatatgccctgatctcatcccaaacacaacaaaagaagacaagacaaaggtgacgaggccgggctggcgggagggggcagaaaccccggtgaggaagagggcttcaggtctgccagctgctctctcgtctgaggaattgccgatgacagtttccaaactgctaccctggaggatcccagagcttcattttaagcagccctttggaaggcaggctacccctctaatgcacaacctgtctttgcagactggtaatgaattcatgccaaagtggtcaattcattttaataaactaatgaatatgcagaggccccaggaagccaaggcagcagtggtggtggactctggagccgactgtaattaggcccctgccctactttctaaaattgcatttccctgccagggagcctgctccaggccttatgagaagaaagtcggtccacagagtggagaaggtgctgctcatggtgacggtgcctctataaacagccccaccactggagaagccttagcttactgagctaattcctgctactgcagctgcctgggctggcgcggggcaccaccaaccaccaagcgcccccgcccgggggctgctgagaaaggccctgctccctggaggcaacaggtgctgagagacctggaacgaaaaacggtcacagacaacccaccagcctttcaaagtcaacgtggtaggtggcgataatctccgagatgtggagaaaccagcactttctgccttggggggtggggaaggaagcggcacccaagagcccagctccagccttcccaactccctaaaccaactttctccctccaggcagctccagcttcccacccccagagcatcgaggcactggagctcagccaaagaacagcagcctctcaccgctcaggacacaaagcccactcagcgagggtttgtctgcagggccaccaccgaggccaggggatcgctagagcccccaggagagaacggccgcggagcaaggggttagtgctgggagccgtgcctgccactcaggactagggcatcccaaggccctcccccagccgcctgcagggggcttttccctcacccagactcttccagctcttgcctgggaccgaactcaccctgaccctgccttctgggcaaggccagggtcctgtgggccaacgggcagtcagtaggcaacttgggaactgacccttgtgctaggggcacaaaacgggccaagtagccaccaagaaaaaggatgccacaaagctgtcgtggacagcagcaggctttctgccctagagactaagcaaggctactaggcagaggcaacaacaaacggcccccacgaaggccgtggtgcatcagccatacctgaagagagaggttcctccccttcccaactaacgggctttgggttttgcagggaggcagaagagcgggtggggtaaccccctggatccgcagaagcggggagacacacgactacgcaggccgctgaggggtaactggaattcagcttgtaaaccagaaggcaccagattaggagaaggggcgacttggaaagaaatgctgcagaagtaaacgtggaaagggagaggcggccctgccgccggcccgtcctaggggtccccaaggctccggcattacccgggtcggcggatgttaaactctgcgtcctaagagcgcttcccttccctccctttttcgagagacagagaacgaatctgtaatctagaaatggtcatttctccagaatgggcactcgagatgagggagagctgagcaggcgcaggagaagggagggagggagggaggggagctctgcctgcgccaaggggacacatccgcccgccccagccccagccccagcccgctgggtaacggtgtgggtctgaagtcaccaccgctggcgacagcccctctccctcaccagtcggactaggggctttcttttaactaacgaaaaccaatcctcaaacacgggagagacaagggaacggggagaagatcagagaaaagcactgaagcccggcacagcaaaggggaggggcaagccgatcagtggggagggagggggaggaggggagaagggggagggggacggggagaggggagaaggacgggtaagggaggaggggagagagagagggaagggtagagggtgagggaggagatggagggagggaggagagggagggagcagatggagggagggaggaaagaggagggagagggaggagatggagggagggaaagagccgaagacccagcgggctttgcactcacccgtgttgtacacgtgcagttcgtccactattccctcgttgccgccgccaaacaccacgatgagctccttgatggccacggcgcggtggccgtggcggggccgtggcaccggacccgaccagcccaccactcgcttccagcggggctgcagaagcaccgctggcaagttggcgggcgacacggccgaagccatagttccgggaaagggtgcggtggggagaagtcaacaagcgggaagggagcccctcaattcctttcacacaccccctttcgtctaaggcagctctcacggagaagcggtttctcacacagcggtagacgactccatggaggccgccatcttaactgccctccttccctttggctcttccctttcttctcgctcaccccgtctccgcaagagccgcccgaaactgtcgagcgcctaggctcaagaagctggaggccgctgagtcccgtcgccccgactacttgtccgggcgctcccgcttacaagctcgggcgggaggccctgggagccgccatcttgagccgcctctctctcctcccttcctcagtcgtagccctcccccgccggaaatggcggagccccggcccggttcccacacccccaagtccccagcactggccggcttccggggcgggtggaaaggagccacaagcgccgcggtcgtcgcagccccgccggcgctcagaccacaattgtgggagccgccatcttgagaccgtcccgcttccccgcccagcgccttagtgcagccgccgctcccgaaacagcctcgacacacctaacgaatggaggcgggccggaggccggtggaaccagctcgagctctcgagggccgtttgggggctcgcgccgtacggcttgtgaagtctcgcgcctctccccttagtccgcctctgctgctcaggctgcgcctgccgccgtgggagccgccatcttgagactagctccccgttcccccctattctcttcctcctaggtcagttcttccactgcacaccaaactcaaggcggtgtccgatcctcacttcccgccttatgactccttcccacaggagccgcttcaaagagctagagttaggccccgaagcggcaactgtacggcagaagaagcggtaacggcagggcgctcatgcctcctccctgggagccgccatcttgtgtgaagaagtaacaactaaacatggcggcagcggcgccggcggtcgggcgaggaggcggagccgggtgacgtcaccgcttccccccactcgccctcgcaccgcttcgcccctgggcccaagcctcttaaaggacccctgcgctgcctcgcggcgggggtgggggtcggcgctgccgcgcgctgggctaaagctcgagtcgcgctcagatcaggtgcaggcgcaggcgcgccccgccccacggcccccccaccgggcgagcctccacgcctccgccctgggagccgccatcttgccacttcccctcgcccggccgtccgcgggcgtcaatagcgactttcagcacaaaacaaagatggcggcggcggcatctcggaaatgcccggatgagactgctaacccctccgacgcgctcggccccgcccccttgggaacggtctctcgggttgataagggacgcacgcccgaagaactgcctttaaccagcactggggacagcggcacgcaggtggccggggttggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggtggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgtaagtgctcaccgcagccctgggaggtgggtcccggcctcgcccccacgtttcgcctcctctaggaggccgcccgggcgcggcggcggcggcggcggcggcggcatccgccctgccacgcgcaggccgcagcgcggggacccaagctgctgcccgggagcggcagtcgccagtagaaatggacagaccggtcctgtcagagcctgtggcttttgttgtaaacgtctagaagttcagttaaattacaagatctaccagatctaccggcgggcagaattattactttgaagttactgaagttatgcgtcctgctggaagaccttgtaatttaatgcgttagtaaagaagcacacgtcaccctctcacacattttcaacaatatttttaaagtcgcctctcaacatattacatgtattttgtaatcgtctgtgttttagttcatgcagttggaagtatccatttgagaagggacaaagagaagaattcttgcctgtctgtgccaccacctgctctttgtgaccttggctagttacctcacatatgtccccaagtcccccacccatggtaaataagaaaactaaggcctgatgcgttggctcatgcctgtaatcccaacactttggaaggctgaggtgggaggattgcttgagcctagccggggcaacatagcgagacccggaggcatggtggcacacgcctgtggtcccaggtacttggaacgctgaggtgggaggatggcttgagccagggagttcagggctgcagtgagctgagatcgcgccactgctccagcctgggcgacagagcaagaccctgtctcaaaaacacacacacacacacacacacacacaaaagcagctgctggtttccaagggccttgcctggaatcagtccagaagctaaattaatgttaattgatattcctttatccacagaaagacagcaagaaaggtcatgcggagcgggggacataactaaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaagctggtcatggaagggtggaaagccagggcagacatgatcccatccagggctgctcaaagatgctggggctgcggtgtgcacacccctggacccagaggcttttttgactgggaggacggggcaggaggagttcgggtgccccatgctgagatggcaggcttgtgtgaagcaaggacgtatggagtgatagtgaggactgtggttcctgtgtggcaacaccatgcttcagagggcaatggggcacccacatgccaagcctggtggccctcctcagcaacggaactccaaggcaagaaggctgagaatgaggcccaggaggatgcggtgggccccaggacctgcttgagaagtgaaatagcaaacaggactggtaaaagggagcagaggtgctggctttgttctttaatataattgaattgaaattgagcagggcttcactgggcatctgaggaagagcaaggaatcagaccctgtcccacccatttggggcctaaattgcagtagggcagatggacattgcacctcaaaaataaacagtgcttgtcacatgaatcatttgcaaatattttctcctatattgtctcttcattgttgattgcttctgtgctgtgcaaaagctttttactttaatatactcccatttgtctgtttttgtttttgttgcctgtgattttggggtcttagccataaaatctttcctggagcatttccccattttcttctagtagttttattttatttattttattatttgtatttatttatttatttattttttgagacacagtctcactctgaaacccaggctggagtgcagtggcacaatcttggctcactgcaaccttagcctcctgggatcaagcgattctcctgccacaccctcacaagtagctgggattacaggcgcatgccaccaccctggctaatttttatacttttagtagagatggggtttcaccatgttggacaggctgggctggaactcctgacctcaggtgatctgcccgcctcagcctcccagtgtgctgggattacaggtgtgagccaccacacccagcctttttttttttttttttttttttttttttttaaagacagagtcttgctctgtcgccccaggctggagtgcagtggtgtgatcttggctcactgcaacctcctcctcttgggttcaagcatttctcctgccccagccccctgagtaactgggattacagatgtgcgccaccacgcccggctactttttgtatttttagtagagacggggttgcactgtgttggccaggctggtctagaactcctgaccttaagtgatctgcccgcctcaacctcccagtgtgctgggattacaggtgtgagccaccgcgctggcctcttctagtagctttatagtttcaggtcttacttttaagtctttaatccatgttgagttgattactgtgtgtggtgagagataggggcctagttttcattcttcttcacatacttatccaattttcccagtgccatttattgaagagaccatcctttccccaatgtaggttcttcgtgcctttgtactacttataatagctaagatatggaagcaatctaagtgtccaccagtggattgatatgtaaagaaaatgtggtatagatacatgatggaatattattgagccatttaaaaataaactgttggcgggcgcggtgtttcaagcctgtaatcccagtactttgggaggccaagacggccagatcacctgagatcaggagttcgagaccagcctggccaacatggcgaaaccccatctctaccaaaaatacaagaattagccaggtgtggtggcaggcgcctataatcccagctacttgggaggctgaggcaggagaattgcttgaacctgggagacgcaggctgtggtgagccgagattgtgccactgcactccagcctgggtgacagagcgagaccctgtctcaaaaaaaaccaaaaccaactataaaaaataaaaaaaataaaaaactattggctgggtgcagtaactcacgcctgtaatcccagcactttgggaggccaaggtgagagggtcgcttgagcctaggagtttgagaccagtctgggcaacatagcaagaccctgtctttcaaaaaaaatttaaaaatttgccaggcatggtaacatgcctgtggtcccatttacctgggaggctgaagtgagaggaccacttgagcctgggaggtggaggctgcagtgagctgcaatcacaccactgcactcagcctgggagacagaacgagaccctgtctcaaagaaataaacaaactaataagataaatcttgttatttgtggcaacatggatgagcctagaggacgttatgttaagtgaaataagccaggaacagaaagataaatattgtatgtgttaattcttatgtaaaatatttaaaaaatcaagctcatggaaatagaagcatagtgggtattagaagctggaaagattagagagtagggaaagattcggaggagtcggataacaaatacaaaatgccagcttcatagcatgaatggatcctgctgttctgcactgtagggtgagcactgttaactacaatttcttgtgtattttcaaaagactataagaaaggatttggaatgttcccaacacaaagaaatgataaatgttccaggtgatggatatgctaattaccttgtttgatcattatacattatatacatgtatcaaaatgtcactctatatgctattaaaaataataaaataggctgggcacagtggttcacgcctgtaatcccggcactttgggaggctgagggggacagatcagttgaggtcaggagttcaataccaccccagccgatatggcaaaatcccatctctactaaaatacaaaaattagccgggcgtgatggcccgcctgtacttccagctactcgggaggctgaggcaggagaatcgcttgaacccgggaggcggaggttgcagtgagccgagatcctgccactgtaccccagcctgccccacagagcgagactctgtcccaaaaaataaataaaataggccaggtgtggtggctcacgcctgtcatcccagcactttgggaggccgaggcgggcggatcacttgaggtcaggagttggagaccagcctggccaacatggtgaaaccctgtctctactaaaaaaaatacaaaaaattagctgtgcatggtggcgggcgcctgtaatcccagctactcaggaggctgaggcaggagaatctcttgaaaacgggaggcagaggttgcagtgaggcaagatcacaccactccagcctggacaacagtgcagacagtgcaagattccgtctcaataaaaaaataaaataggccaggcacggtggctcatgcctgtaatcccagcactttgggaggccgaagcaggtagatcacgaggtcaggagttgaagaccagcctgaccaagatggtgaaaccccgtctctactaaaaatacaaaaattagccgggctaattttagttgtaatcccagctactcaggaggctgaggcaggagaatcactcaaaccccggagggagaggttgtactgagccgagaccacgccactgcactccagcctgggcgacagagcaagagtctgtctcaaaaaaacaaaataaaatgaagtaataataaaatagtgctaagtggtctgcatatacagatactttttttttttttgagacggagtctcattctgtcgcccaggctggagtgcagtggcacgatcttggctcactgcaacctccgcctcccaggtttgagcgattctcctgcctcagcctcccaagtagctggaactacaggcatgagccatcacgcctggctaatttttgtattttagtagagatggggtttcaccatattggccagggtggtcttgaactcttgacctcaactgatccacccacctcagccacccagagtgctgggattacagacgtgagccaccacgcctggccactttttttttttttttttttttttttgggggggagagggagtttcgctcttgttgcccaggctggagtgcagtggcgtgatctcggctcactgcaacctccgcctcccgggctcaagcgattctcctgcctcagcctcccgagtagctgggattataggcatgtgccaccacacctggctaattttttgttttgttttgttttgttttgttttgttttgttttgttttgtttttctgagatgaagtctcactctgccgcccaggctggagtgcaatggcacgatcttggctcactgcaacctctgcctcctgggttcaagcaattctcccgtctcagcctcccaagtagctgggattacaggcgtgcgccaccacgcctggttaatttttttgtatttttgtagagacagggtttcaccatgttggccagactggtctggaactcctgacctcaagtgatccacccgcctctgcctcccaaagtgttgggattataggcgtgagccaccgtgcccggcctaatttttttgtatttttggtagagacggggtttcaccacattggctaggctggtctcaaactcctgacctcagatgatccacctgcctcggcctcccaaagtgctaggattataggtgtgagccactgcgcctagcttttttttttttagagatagggtcttgctctgtggcccatagctcactgcagcctccatctcctgggctcaagtgatcttcctgcctcagcctcctgaggagctgggactataggtgcaccaccatgcctggctaatttttattttattttttaaatttaattttatgtattttgtgtagagacagggtctcactttgttgcccaggctggtctcaaactcctggactcaagcagtcctctcaccttggccttccaaattgctgggattacagatgtgagccaccatgcccagctacatatgctttttgatgtataacagggtaatgtccagataaacccatcataagtcgaaaatataggaactggactttcaacttaagaggggtttagctgggtgcagtggctcactcctgtaatctcaggactttgggaggccaaggcaggaggatcacttgaggccaagagttcgagaccaggctgggcaacatggtgagaccctgtctctacaatttttttttttttttttttttagatggagtcgcgctctgtcgcccaggttggagtgcagtggcgcgatctcagctcactgcaagctccgcctccagggttcacgccattctcctgcctcagcctcccgagtagctgggacaacaggcgcccaccaccacgcctggctattttttgtattgttttagtagagacggggtttcaccgtgttagccaggatgctctcgatctcctgacctcgtgatccacccgccttggcctcccaaagtgctgggattacaggcatgagccaccatgcctggcccaaaatttttttaacaaaaattagcagggcaggccgggcgctgtggtagggaggctgaggtaggagaatggcgtgaacccgggagatggagcttgcagtgagccaagatcgcaccactgcactccagcctgggcaacagagcaagactccgtctcaaaaaaaaaaaaaaaaattagcagggcaaggtggtggtatatccctggtcccaactacttgggaggctgaggcaggaggatagcttgggcccaggaggtggaggctgcagtgagctgtgattgtgccactgcaccccagcctgggcaacagagcaagacccccgtgtctaaataaaaatacccaggccatggcagcagaaagcaaggaagaagccacgtggaagccctcctggcgcttcttccagggaggtgagcagagagcacctggggccaggaggcggcatgcctgggtttctgctcctcctcactgtaactttcagccaagtcaaactgctagagtttcagtttctttatctgtgaaatgccggggctggcacagatggtttctaagatccctcccaggcctggaacttctaagcgattaggtcaaaggtgagctaaccgggctgggcacagtggctcatacctgtgaatcccagcactttgggaggctgaggcgggtggatcacttgaggtcaggagttcaagaccagcctggccaacgtggtgaaaccccaactctactaaaaatagaaaagttagccgggcatggtggtacacgcctctaatcaccgctactagggaggctgaggcaggagaatcacctgaacctgggaggcggaggttgcagtgagccaagattgtgccactgcactctagcctgggcaacagagtgagactccgtctcaaaaaaaaaaaaaaaggtgcacaaaccgaggcccaagacagttaaggtgcaagatcacatggttagtaagtgggagagccaaggtttgaacagtctggcatcagctgaccaggaactggagcccacccttctctctccctgagcccgcctacccgcccaccctcttgagtgcgaaatttattaatatggaagggagaagagctttaatgattggagtcattttcagagcattaaagctcttctcccttccatattaatgtatttctcagctactagggctcacttacagcaccagtggccccaaagcagttgacagtcagtggtaattaaattgtctctctggttctgtgactgaaggagacagaaggctttatggtggcctgaggaaagaaggtgatttggggcttggcacttcaggagagggcaggcgagtgagccagggaagctggcctgggaagcctgcgggtcacccccttgcctcccggcctggtgcttgagtggcagacggtgaatcctcctcctcctccatcccccaccttgtgtcagaggccagagctcggactccatctaatggtctctagttcagctgggtatttggtgaaaagggctttggggctggagacgtccacttttataacacactgacatgggaaggcgcattctgagttgtaatgacagagctagacaggtcttgtctgtagatgcagtggctttaaggaaactaggacgatgggcaggattttcctaggtgccaggagaaaggggtgatagaggattctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagagcgatcgtctggagtatctttggggtgtcagctctgggtgtggactggcagcagtgaggcaggccagtcagtggggtaccagtgagtgtccttagaggcggctggattcagggagactgagtcacactaaatacgtgcccagcagactgatggggaaatcactcaattatccccatgacatctgtgactgttaactgtaggcaggtcacgtgagagccacatcacctcagatcgtctgtggaaccaggcagtgtgcatccagatgaggaaacacacaaatgtcaaaagttgaactctcaacagaaagttgctttgtgggtctcccctcagagccagggtgtggcttagatgcccttagtggctacagtctgagcagtccccacctgcccgtcacccaggtccttgcgaaccagtctgctgacagtatcgtcaggcactgtgctggaggcggcacgtgcttctcatgcaggcaacagtttttgagccctcgagcccaaggcccagactctctagtttgtggtcaggatgctgggtcattcttagccgcagccagagaggcactgaggactccgtgccaccctctctactcccgggacagtccttcctgccggtcactatgttacttagaggcctgcctcacctcctttcatctgaaggcatctggtctgtaaaggggacttccttttttcgagacagagtcttgctctgttgcccaggctggagtgcaatggtgtgatcttggctcactgcaacctctgcctcccgggttcaagcgattctcctgcctcagctgcctgagtagctgggattacaggcacccaccaccacgcccggctaatttttgtatttttagtagagacggggtttcatcatgttggccaggctagtctctaactcctgacctcaggtgatccgcccgcttcggcctcccagtgctgggattacaggcatgagctcccgcgcccggcctgtaaaggggactcctgaagacaggtaatgtcatttaactcaggggctcttcatcccagactccatagtcttgtccctggagccttaagtactaaggagggtctgctttaagcccacaaattaaatggagaagtgaccagctccaaaggtgagggcagaggagagaggatgccctgtccctgccaaatggcatctcagcatgggccacccatgtgcacctgctcagtgccctcgaggttggcattcggcccacgactgtgatgactgagatgtttctggaactgggcacctgggctggatgttctgtcctggctggctgagcacattgccaccaggtaaggacctggggcaaatggcaggacccgacccagggcttggggcctgggggtggggcacgtggttggcaggggagagcaaggacagcacctgcttgggaaacagcctggttccatttgaggtcgtctcgaaagcaccatgtgccctagaagagggaagaggctgcacacatcaccagagaggccacccttacttcacagaggctggagggagggcgaaaagaaggcgggcttccatgcgggctcagagacagggtgggggcaggctcttcatccagcagtgggggatccccttttgtgatttctctgtgagtagctgtttccctcattgacagaggactgctgggacttcatgccacacctcgcagcaacaagcactcatcacgattttactttttcttcctaccaatacctgtgtaataaacagccctgcgagcctcctgggtcaggcggggtcccacgggaaacaggtggtgtgcctagattggggtgattcagggcggttttgtgggacacctggaagagtggaccccacccaaaggagaggcttatgtggaggggacacctccagaggggcagggactgcaggaagcctggctccgctccctccctctcctgccagagttgccagattatacgccaggcgatgaacaatggttttgcacaagcgtgtctcaaatgttgcatgagacatttctcctactaaaaaagtattgtttacctgaaattcagatttcactgggtgttctgattgttatttgctaaatccaacaaccacgtcctgagccaacacaagcagagccagaagccccggaacctgcgcaaggcagagcaggtggcaaagaaggctccaggcaggccccggcctggaacctgcactccccaggccctttttgaaattagtgtttctccaagtatggccagttgccattagtcacacagcttcctgcatcccttcctgcccaggcgaaccccccttctggggccgggacctcagagtgcctcagccctggcccggggtttgcggattccaccaacccctgagccactggaggaaggaggctggcggctgtgcctccctccagctctgcagtccacggaggagctcggcctcgcccagggggattggctgtcagggccgccgttgccgttactggtcttggtctcagtctcgctgctccactgcgtccccagcacagctggggagccaatggttgccagatggggcctctccccgacctttgacctaacggtttagaggttccaggcctgggagggatcttagaaaccatctgtgccagccccggcatttcacagataaagaaactgaaactctagcagtttgacttggctgaaagttacagtgaggaggagcagaaacccaggcatgccgcctcctggccccaggtgctctctgctcacctccctggaagaagcgccaggagggcttccacgtggcttcttccttgctttctgctgccatggcctgggtattttctccccacataaaatagttttagggcctggcgctctggctcacgcctgtaatcccagcactttgggaggccaaggcgggtggattatctgaggtcaggagtccgagagcagcctggccaatatagtgaaaccctgtctctactaaaaatacaaaaaattaaccaggcatggtggtgggtgcctataatcccagctactcgggaggctgaggcaggagaatcgcttgaacctgggaggcagaggttgcagtgagccgagatcacgccactgcactccagcctgggcaacaagagcgaaactctgtctcaaaaacaaacaaacacacacacacacaaaaatagttttaagcccggtgcagtggctcacgcctgtaatcccagcactttgggaggctgaggcgggtggatcacctgaagtcatgagttcaagaccagcctggcgaacatgacaaaaccccatctctactaaaaatacaaaaattagctgggcatggtggtgggagcctgtaatcccagctacttgggaggctgaggcaggagaatcgcttaaatccgggaggtggaggttgcagtgagctgagatcgtgccattgcaccccagcctgggcaacagagtgagactccatctcaaaaacaacaacaaaaatagttttaggccaggcgcagtggctgatgcctgcaatcccagcactttgggaggctgagaaggaagaattgcttgacctcaggagtttaagaccaccctggacaacgtagggagaccccatctctaccaaaaataaaaaaaattagctgggcttgatggtgtgtatttgtagtctcagctactcaggaggctgaggtggggaggatcacttgaacccaggagatccaggctgcagtgacacagttgtaataagatggcatcactgcactccagcctgggtgacagagcaagaccccatctcaaaaaaacaaaaaaattacagcatagggcacacactatcatgcattcgcttttctgggccccattttggcttggtgacgtgccaaggtctgctagaaactgcacacactggcccggagcaggcccttctccagttaggtctcaggagtgggattgtagggctgaagggaacttcagtttcaaatccctggagtgcttttcccagtgacgttcttgattcacatctctagcagcaatgtgagaggcttctccgccccccaccagcaaatgtcagggtgggtgcattttcatggtgtgccaatctgatgagggtgacatgagatttcattgtgactaactcagaccccttcccctctctcaccgaccccccgccaaaagtagtgtgtgtgcatttttgagacagggtctccctgtgtcccccaggctggagtgcagtggcgcaatcatggttcactgcagccttcaactcccaggctcaagagatcgtcccacctcagcctcccaagtaactgggactatgggcgcaggccaccatccctggctaattcttttgttttgtttttgtttttgtttttttgagatggagttttgctcttgttgcccaggctggagcgcaatggcgcaatcttggctcactgcaacctctgcctcctgggttcaagcgattctcctgtgtcagcctcccgagtagctgggataacaggcatgcgccaccatgtctgactaatttctgtatttgtagcagatacggggtttctccatgttggtcaggctggtcttaaactcccgacctcaggtgatctcacctcggcctcctaaagtgctgggattacaggtgtgagccactgcacccagcctccctggctaattcttaaaaaaaaaaaaaaaaaaaagaaaatttttttttaaaattactatgaaatgtattatttgttattaagttacaaattttttttttttttttttgagacggagtctcgctctgtcgcccaggctggagtgcaatggcgcgatcttggctcactgcaacttccgcctcccaggttcaagcaattctcctgcctcagcttcccaagtagctgggattacagctaaaattagcccggctaatttttttgtatttttagtagagatggggtttcaccatgctggccaggctggtctcgaactgacctcatgatccacccgcctcggcctcccaaagtgctgggattataggcatgagccaccgcgcctggccagagcccagcctaattcttacattttttttctagagatggggtctctctgtgttgcccaggaccacactcctgccttgccctcaaagtgctgggatgacaggcataagccactgtacccaacctcctcattttgtcctcggactcctgggctaaagcaatcctcccaccttggcatcccaaagtgttgggattacaggtgtgaaccactacacccagcctattgtttgtcttctgaagatttatgtggtcatgcatgtctgtctttttcttcgtagctttcggggttggtcttccttaaagcagttttctgagtgtctaggtaacacttgtctgtacctcagctaactttgttaaatctcagcatcgcctgtagctgcttcagatgtttttattataacattttcattataaaattattagatagttaaaaattatgtttataaagaaaacaatgcggctgtcacattgctgacatgacggtttacgtaactatagtgaagtagtgcacttggtgagggagggaaatgccagcacgcttgggcaaggtgcctcattgcagcctgggagaacgaaggtgggtgaggcatttccctcccacgccgaaggcctccgggaatagaaataccgggtaaatatccactggccagttcgtatcctccagtgggtcatcatgtgattggggagcgcttcttcccattcaaaggggatctttggggacccgggtttatggaaccctctctgcgttggtcctgggggctgcttctctgttcagtgaccctgtgactggagggcactgccttggcccggcgcgtggccatcttgttcctagggtcactggagcctgattgctgtggtggcacgccaggtccttcaaagctttcatgtttttattttattattatttcttttctttctttctttctttctttctttctttttttttttttttgagactgagtctcactctgtcgcccaggctggagtgcaatggcgcagtctcagctcactgcaacctccgcctcccatgttcaagcgattctcctgcctcagcctcctgagtagctgggatgacaggcatgagccaccacgcctgccctattttattattattttaaattttattttagtttcgggggtacatgtgcaggttggttccatagacaaattgcatgttgtgtgggttttgtgtacagattatttcatcacccaggtattaaatagtaagcctcatacccaataggtgatttgtttctgtttttctagcctttccttccattgccggcctttcactttgatctttgctgtctgtttctctttggaaccgctgacttctggttttgctcttgcctcttctcggccccacttgacctccactggggcctgggctagcttgtgtgtgccgccaccatctcggccagctcaggtctgtttctttggaagattctgtgcccctcccatgcctctcctgcatgtggcccatgcacagtagtgtgtggctgccctcgcccttgtgtgtgggttttttgttgtgttgttgttgttttgttttgttttgttttgtttttgagatggagtcttgctctgtcacccaggctggagtgcagcggcacaatctcggctcaccgcaacctcctcctcccaggttcaagtgattctcctgcctctgcctcctgagtagctgggattacaggcgtgcaccaccatgcccggctaatttttgtatccttagtagagatgaggtttcagcatgttggccaggctcgtctcgaacccctgaactcagctgacccacccacctcggcctaccacagtgctgggattacaggcctgaggccctgctcccagcctccttgtgtttctctacgtgcacattgtgcagagcctccccacccggctggacgtgaccgatggcacacgtccccagtctcacgctcctgtgcacgcctcttggtgcctatgtgtgagagcttcgcatttcaactcgagtagaatttgccaaatcccttgccagattgggggcagagctcctcaacagcacttgatgtggtcaccggggtgatctgctgatctgacaggagtgagtgacagtttcattttgtccttgtttgcctttttcagcttaaaatcgaggttgcctcaaaacattaaacatagaattcccatagggtccagcagttccactgctgggtataggcacaaaggagttgaaagcaggagcttgaagggatgcaattcacagcacccaagaggtgagagctggccaagtgtccatggatgaatacatagataaacacaatctgctttatccacacaatggaatattattcagccatgaaaaggaagggaatccttacgcaggctaccacatggatgaacctggaggacatcataattagtgaaagaagccaggacagaaagtacctgattccacttttgggagggacctggtgtcgtcagactcagagacacaccacaggatgatggtcgccagggtggggagagtggtggggagttagtcttttttttttttttagacggagtctcgctctgtcgcccaggctggagtgcagtggtgcaatctcggctcaccgcaacttccacctcccgggttcacaccattctcctgcctcagcctcccgagtagtgggactacaggcgcccaccaccacgcccagctaattttttttgtatttttagtacaggtggggttcaccatgttagccaggatggtctggatctcctgacctcgtgaaccacccgcctcggcctcccaaagtgccaggatgacaggtgtgagccaccgcgcctaacctggagttagtcttttttttctttctttctttttctctttctttctttccttccttcttttgtcctttcctttctttcttctttctcttctttcttctttcttctttttctttccttccttccttcttttctttctttctttctttcctttctttcttctttctttgcttccttccttttcttttctttctttcttttcttccttcttttcttctttctttgtttttttctttctcttctttctttccctttcttctttctttccttcctttcttctttctttccttccttcttttccttctttcttttctttccttccttcctttccttctttcttttctttctttcctttcttttcttctttctttcttctttctttctttgcttccttccttcttttcttttctttctttctttcttctttctttcctttcttttcttctttctttctttctttcttctttttttctttctttctttctttttttttttcagagactcactctgtcacccaggctggagtgcaatggttagtgcgatctcagctcagtgcaacctctgcctccccggttcaagcgattctcctgcctcagcctccagagtaactgggactacaggtatgcaccactgtgcccagctaattttttatattttattttattttattttattttatttattttattttattttattttatttttgagatggagttttgctcttgtcgcccaggctggagtgcaatgcacgctattggctcactgcaacctccacctcccaggttcaggtgattctcctgcctccgcctcccgattagctgggactacaggcctgcaccaccatgcccggctaattttgtatttttagcagagacagggtttcaccacgttggccaggctggtctcaaactactgacgtcaagtgatccacccccactcggcctcccaaagtgttgagattacaggcgtgagccaccgcgcctggcctctacttatttatttcttgtagagatggagtctcaccatgttgcccaggctggtcttgaacccctgggctccagtgatcctcctgcctcagcctccccaattgctgggatggcacacatgagccacggggcccagcctcctcattttgtccttaatatctgcttgtaaccacctcaactcagaatacctaccaaaacttagtttggatgtgtttcccaggttgcaatcctcaaatttggcccaaatacactctccttgtattaattttacctcagtgtgttcctttaggtcgacctcataaaatctggtatgggtaattctgcagagccactccctcaccaccgctgtctcgggccatgctggctagcagcgatcgagggcttactgtggacgaaagtcagtttagagaagttgaatggccaagttcacagcagtaggaagtggctgcggtgggctttgccctggggctttggactttgcctggagctgctcctcactcattccaggaagctcttgcaccatgaccgctgtgacttgggatccaaatttcaattgaaaatatatttttttcaatttttttcatttttaaaatttttttagaaactgagtctggctctgtcacccaggctggagtgcagtggtaggatcacagctcactgcagcctcaacctcctgggcttaagtgatcctcccatcccagcctcctgggtagctaggagtataggtgctcaccatcatgctcagctaatttttcttcttttttctttcctttttctttctttctttttttttttttttttttgtagaggcagggtcttgctatgttgtccagttgtcctgggctcaagccatcctcccacctcagcctcccgagttgccaagattacaggccactgtgcctggcccgatgttttttattggggtaaaatacataataacataaaatgtaccatgttaaccagttttgtggttagttagttcagtggtgttacctacattcgtaatatggtgcaaccaacatcatcgtccatctccggaactcttttcatccttctaaactgaaactctatccccattaaatgctaactccccagtccccctcctgcagcccctggaaaccacccttcaggtgtgccacaggtcaaatgtggacacagggaggccactgcacccggccctcagcatctgaacttccacccctgctgcttgaagctctccatctcgccgtccagacaggctgccttccccgctggctctgtataggatgcaaccccaacaggtggagaagctcagcccgcagcacccacacggagccgagatgtgcaggttgccgagccggccccgctgggggggcttctgctgggacagacataacaaacagcagatgtagccccctgccgaggacttcagattgggaattgtcagagattccggagattgtcagattggatggaaacccccacttccagcatatgctgtttactagagacacacctcaaacatatgtccatggaaatattacatgtgaaagaatgaatgctaggcagttactaccaaaagcaagctgccatggctatattaacatcagacaaaataggctttgggacaaaacaaaaacagtttaggaatgatgttaaaataggctctacatatcttaagcaaaagttgacagaactctagggagaaataggcacatgaagcatcgtagagggaggtttcttttttttttcttttttttttttttttttttgagacagagtctggctctgtcgcccagactggagtgcagtggcacaatctgggctcactgcaagctccgcctcacgggtttgagggattctcctgcctcagcctcccaagtagctgggactataggcgcccgccaccacgcccggctaattttttgtatttttagtagagacggggtttcaccgcgttagccaggatggtctcgatctcctgaccttgtgatccgcccgcctcggcctcccaaagtgctgggattagaggcgtgagccaccgtgcccggcttgcagttttcttttttaaaatgtttatttctattttgtgattcaaactgaggatcatcttgctgcaaagaagtttttaagttgataagaaactgctgaacagtgattcaaagtggctgtgccatttcacactcctgctggccgcgtgcgaacctttcatgcactccgcctcctcaccagtgctccctgcgaccagtcttcagtgacagtcattctgggtgcgattttatcttgcatttccccatgagaaatgggcatctcttcctatgcctcagtggggagaaccagagacgggggcagaagaggggcaggagaaggcagggagggtggttggaggagagagcattgggtgggggtggcaagtgctggaggagggggacggggaagtgggccctttgctcttgaaccattttaaccccaagcaaggtgcattcagggtttgggcaggggtctggccctcatgtcaccagatcctgagtgactgtaggggcctctcatcatgtcttcactcctggacttgctggctccaggtgagaagacgtggacactgctgtgggctgcagaggtttgggggtgtgtgtgtgtgtgtgtgtgtgtgcatgtgtgtgtgtgtgtgtgtgtgtgcgtgtgtgcgtgtgtgcatgtgtgcgtgtgtgtgtgtgtgcatgtgtgtgtgtgtgcatgtgtgtgtgtgtgcatgtgtgtgtgtgtgcatgtgtgcatgtgtgcgtgtgtgtgtgtgtgtgtgcatgtgtgtgtgtgtgtgtgtgtgtgtttgagacagggtctcaccctttctcccaggctggaatgcagtggcgcgatctcggctcactgcaccacggacctccgggctcaggtgatcctcccacttcaaccccctgaataactgggactacaggcgcacggccccatgcccagctaattatgtaattatgtcacttttcatagagacggggtctccccatgttgcccaggctggtcaggaactcctgggctcaagcgatccacccgtctcaacctcccaaagtactaggattccaggcctaagccactgtgcctggccttcagggttttaaggaacagtttcatttccacagtggggcggcttgagaagtaggggcaccccaccagcagctgagcagagaagaaatggtggctatcagacagcccaggcctagtgaatcctccagtgaattattcctggcctttaagagacaggtaattccagcgaggcgcagtggctcacgcctgtcatccaagcacttcaggaggccgaggtggacggatcacgagatcaggagatcgagaccatcctggctaacgcggtgaaaccccgtgtctactaaaaacacaaaacattagccgggcgcggtggcgggcgcctgtagtcccagctactggggaggctgaggcaggagaatggagtgaacccgggaggcggagcttgcagtgagccgagatggcgccactgcactccagcctgggcgacagagcgagactccgtctcaaaaaaaaaaaagaggtaattccagggtttcaaagaaagtaaagtttccagatgtgctttatgaagccagaataacctttgtcccccaggagaatgttagtgtcacaaagacagactcttgtgggtcctgcttgcttctccgctctgagtccacagcggtgtctggcacacagtaggtactcctgggtgactcactgaatctggttgcagacttgacacacacacacatgcacacacggaaaagtatcgatactgctgttaaacactggtaggcatttctaaaataaaaacattagctaatatcatccaaaagcagatcaaggcatgaatatccaggctgggcgcggtggctcatgcctgtaatcccagcactgtgggaggctgaggtgggaggattgcttgagcccaggagtttgaggccagcctaggtaacatggtgagtctgtctctaaaaaaaaatacaaaagttaggtggggatggtggtgcgagcctgtggtcctagctactcggaggctgagggagaattgcttgggcctaggagtctgaggctgcggtgagccatgatcacaccactgcactccagcctgggtgacagagggagacctgtgtgaaaggaaaataaatcttggggcccccaaatcactcagctaaagggaaaactcaagctgggaactgcttagggccaacctgcctcccactctattcaaggccactcctctgttcactgagataaatgcttattggattgcttcctttggagaggctcatgagaaactcaaaacaacacaatcattggtctcttatctacccatgacctggaagccccctccccacttcaagttgtccctttctggaccaagccaatgttcatcttacatatgttgactgatgtctcatgtctccctaaaatgtataaaaccaagctgtgctctgaccacctcgggcacatgtcgtcaggaccatcctcaaccttggcaaaacaaactttctaaattcactgagacctctctcagatattcagggttcacacctgactcttaaaaaaagcaaagaagtgaataaactataaccaaatgtacacaacatattgttattaaccatagtcacgatgatgtacaacaaatctcttgaactaattggaattcctcctaattggaattttgaatcccttggccaacatctcctcatccttccctccccacccaccaccctgcagcccctttatgagttcagcttttttattttctacatatcagtgaggttgtgtggtatttgtctttttgtacctggcttatttcatttaacatagtgttccccagtttcacctattttgttgcaaatgacaggatttccttctcttttatggctgaatgggattccgttgtgtacagatatcacactttctttatccattcacccattgataaactcttaggttgattccatctcttacctgttgtgaatagtgctgcaatgaacacgggagtgcaggtatctctttgacatggtgatttcaaatttaaatatatacctttaaatatataccaagtagtgaaattgctggctaatacggtagttgtgtttgtagtttttggactatactgttctccgtactgtctgtgctactttacattcacaccaacagcgtacgaggttcccatttccctgcatccttgtcagcatttgttatttttttaaacatctttttgttaaaagccattttaactggggtgagatgatatctcgtggtgcttttgacttgtgtttccctgatggtgagtgatgtggagcattttttcatagacctgttggccatgtctattcagatcttttgcccactaaaattttctttttttgagacaggacctcactctgtcacccaggctagagtgcggtggcatgaccacagctcatgcagcctcatcctcctgggcccagtcaaccctcccacgtcagcttcctaagtagaaaaaggccagctgtggtggctcacccctgtaatcccagcactttgggaggccgaggcaggtggatcacctgaggtcaggagttcgagaccagcctgaccaacatggtgaaaccctgtctgtagtaaaactgcaaaaattatccgggcgtggtagtgggcacccgtaatcccagctacctgaggctgaggcaggggaatcacttgagcccacggcacgtggatcacctgaggtcaagagtttgagaccagcctggccaacatggtgaaaccccatctctactaaaaacgcaaaaaatgagccaggtgtggtggcgggcccctgtaatcccagctgtctgggaggctgaggcaggagaatcgcttgaacctgggaggcggaggttgccgtaagccaagatggttccactgcactccagcctgggccgcaagagtgaaactccatctcaaaaaaaaaaaaaaaaagtgaaatctgcagagatgacagcttcatgagctgattgtatgaagccacaaacagtactgtgcttaatggtgaaacaccacagcattttcattagtcaagaatgagacaatattcccaggatcaccactgtttcttcccgtttcccaatgttaaattggccaatgcaattgaaaaagttagccggacgtggcgcacaaggaatacgtgttggaaggatgaagcaaagttctcattctttgtaaatcacttgattgcaccactgaaacgtcctctggtctgctgggcaggtttgagtcaggagattctggctgtcttcactgggcctatctgagactgggtgtcatttgctttgctcttgtctgattttactgtcagacatcactcctgtaaccagtctttgtagtaagtctcatttcttgcatgtacttggaagtacatgcaataaatggttttattttcccagcgactgtgcccgcccccaccccattgagttgtgccaaatcccccttaagacgtggggcccgagtccatcatgtttcagtcaggttgcttgtaattagtcttattctggttcttttttcttttcttttctttttctttttttttagacagagtctcgctctgttgccaggctggagtgcagtggcacaaactcggctcactgcaacctctgcctcccgggttcaagtgattctcctgcctcagcctcccaaatagctgggactacaggcttgcaccaccacacccagctaatttttgtatttttagtagagacggggtttcaccatgttggccaggatggtcttgatctcttgaccttgtgatctgcccgcttcagccttccaaagtgttgggattacaggcatgagccaacacgcccggcctggttgtcttttcttttctttctttttttttttttttttttttttttaagacagggtctcactctgtcacccaggctggagtgcactgatgagatctagactcactgcagcctcaacttcctgggcttaagcgatcctcccacctcagcctcccgagaagctgggactacaggcgtgcaccaccacgcctggctaatttttgtatttttagtagagacagggtttcttcatgttggccaggttggtctcaaactcctgacctcagctgatccacctgcctcggcctcccaaagtgctgggattacaggcatgagccacgactcccggcctacccttaattttttttttttgaagtgcacaagctaattttttaattactatttgtagagattaggtctccctgtgttgcccaggttggtcttgaactcctgagctcacgcaatccatctaccttggcctcccacaatgctggactgcaggtgtgcaccacgctctggcatcattctggttcttaaacccaagggtacttattttccaacatgaaccttaacctcacccttccagaaacttctcaggcatgggcaaggttgcagtctcccttactgcaggcagcaatgactttagcaacaggtgatcttggtgggctcgtaggggagtgggaatgggcagtggcttttgtcctccttttgttgtccgctggggatcttggttgggaagcctgaacccagcattgtttcctagccctgtgttcaacaatgccgggagcgaggtgccttcctatccccgtgataaacagttctgggacctgttgctctgccacacaatcctgagaactagcacaagtcaattcgcttgcaggaccaacacacccatgctcctgaaagatgagactcgcagagcccggcccgagactgcacccagccgtccaaggctgaccatgcttcccacccggccctccccacgccggctcggacttcgggcattttctctcctcctttcctccctggtgatctgaggccggctctgtcgggggagtgttcttcctctttgcagtgagtccaataaactcagctttgcctgaacaacaggtttttctggtggtgattttggggagtctacagccaacagctgaaattgggaaaacggggcgggggtggggaatccctttttgttttttgtttttattttttacagtaaagtgaaagcaagtttattaggaagatagaggaataaaagaatggctgctccatagacagggcagctgggaatcccttttagcacctggtggctgcagatgggtagaaatacagaccatatttggttcttagtttaattagccagagacgcagaacagggtgggaagccagacggccacacctagcacctcatcaggctgcagccaaccagggcctctcggggctgggaaaactcgattcttgctgtacttgggcttactcggctctccatcttatgcaaacacctctccttatgaaaggcaagaagaatttgttctacactggggatgggttgtgcctgtcacatggagcagcctggggacctagagggaccctttagaagcttagcacctagcaattccttttcacatgtgactcatggtctattcagttttagtacttcttttttttttgacagagttttgctctgtcacccaggctggagtgcaatggcgcgatctctgctcaccgcaacctctgcctcccaggttcaagtgattctcctgcctcagcctcccaagtagctgggattacgggcacgcgccaccacgcctggctaatgttgtatttttagtagagacggggtttctccacgttggtcaggctggtcttgaactcccaacctcaggtagtccccctgcctcggcctctcaaagtgctgggattaaaggcgtgagccaccacgcccggcttttttttttttttttttgagatggagtcttgctctgtcgcccaggctggagtgcagtggcaccatctcagctccctgcaacctccgcctcttgggttcaagcaattctctgcttcaccctcccacgtagctgggattacaggtgcccaccaccatgcccggctaatttttggatttttagtagtgacggggtttcaccatcttggccaggctggtcttgaactcctgacctcgtgatccatggcgcctggcctactacttctttattcatttattttttgagacggagtctcgctctgtcacccatgctggagtgcagtggcacgatctcggctcattgcaacctccacctcccgggttcagcttcccggatagctgggactacaggtgcgcgccaccacgcccagctaatattttgtattttgtaagtagagacgtggtttcaccgtgttggccagggtggtctcaaactcttgacctcaagtgatctgcctgcctcggcctcccaaagtgctgggattacaggcgtgagccactgtgcttggcgcagttttactacttcttgagacaactctgaagatttctatttttcacagaaagtcattcagttaatctagacttttcaaatgtattgccataaagttatatttactattttaaaattttaatttcctccttaacccaacatttatttaaaagggtcatttcagccgggcgtggtggctcacgcctgtaatcccagcactttgggaggtcgaggcaggtggatcacctgaggtcaggagtttgagaccagcctgggcaacatagtgagaccccatctctacagaaaaataaaaaattagccgggcgtggtggcacacatctgtagtcccagctcctcgggaggctgagatgggaggatcacttgaacctgggaggtcgaggttgcagtgagccatgatcgcaccactgcactccagcctgagtgacagagccagatcctgactgctgctcatagagatctcgcctaaagatcttgcctaagtgcaaaaacacacacacacagaaactggaacaaccgaactgaccctttggggaggctggcgaaataaatgacatggagtacattcatacagctctaaaaaaggacaaaagtcagggacatctgtgtccagggaacactctcgatttgtcttgttaagtgaaactggcgaggcgtggaatcatgagagaagcgtgagtagaggggacttaaaccagggactggtggccacagctagtgttagccaggggactggaggctgggagactgagaaggagattttcttacttcgtacgtgtctgtactgtttggattttttttttttttttttttttgagagggtattttttaaaaggaaaagcttgttttgtttttctttttaaaaaataggctctaaaaattctggagagaaataaaaaaggcaacatggtggccgggtatgggcgtctcttctgattccaggctggttggcactggccaccttgctcaatggttgccttagaaaccggcctagcgagggggtgtcagttgtctctggtagccattaaggcagtgactcagcagaaaacccaacccaagagggagttgttcattcactgactttccttctctcccagaaaagcatgggtgaggccatttctgttacatttgcgatcgggtggcagctgctccgccgtgaaggcggtagcgagaagtctgcccgctcctccagcctctcactaggtgagtggcgtctctgtgctgccctgtccctcagaaaccacaggttccggtccctctgccagcctgtcccctgtctctcccctcccgctgacagggtgaaaccagcttccgctcacaagcacttgctgggggttgccacaggcatggctcttggggagatctttagtaaaaaacccaaccaaacatcacgagtggaaccgagtgtggatcataaactcaactgagagaaaagccaagggacgcatgtgggcaaaatacacagaaaacccagcatgggcgcgggggctctcgcctgtcatcccatcactttgggaggccaaggcgggtggatcacttgaggtcaggagttcgagaccagcctggccaacatggtgaaaccccatctctactaaaatacaaaaattggtcgggcatggtggtggacacctgtaatcccagctactcgggaggctgaggcaggagaattgcttgaaccggggaggcggaggttgccgtgagctgagatcacaccactgcactccagcctgggtgacagaatgaggccctgtctcagaaaaaaaaaaagaatcacgtgctgagacatgctacaacacagatgaaccccaaaatcataatgctaagtgaaagaagccagacacgaaagatcccatgagtattatcccatttatatggagtgttcagagtaggtgaatctatagagacagaaaggagatgagtgactgcctcagctggaagggaaaatggggaagaaatgggtagtgactattaaaaggtatggtgtttttttttctttgtttttgttttgttttgttttgttttattttgtttttttgagatggagtctcgctctgtcacccaggctggagtgcagtggcatgatctcggctcactgcaacctctgcctcctgggttccagcaattctcctgcctctgcctcctgagtagctgggactacaggcgcccaccacgatgactgggcaatttttgtatttttagtagagatggggtttcatcgtgttggccaggttggtctcaaactcctgacctcaggtgatccacccacctcggcctcccaaagtgctgggatgacaggtgtgagccaccacgcctggccagtgtttctttttggaatgatgaaaatatgctcaaatagagtgctggttgcacaagtctgtaaatctattaaaaacacggagttgcacacttcaaacaactgaaccttgtggcgtgtgaggtagatgtcttaacacagctgttaaaaagcccaggatagctgggcacagcggctcagctgtaatcccagtactttgggggggctgaggaaggaggatcgcttcagctcaggggcttgagaccagccttggcaacctagcgagaccctgtctgtactaaaaataaaaataattagctgggcatggtgacatgcacctgaggtcccaggtactcgagaggctaaagcgggggctgtgggcaggagaacaaggctgcagtgagctatgatcacgccattgcactccagcctgggcaacataatgagatcctgtctcaataaacacatgaaagagacacatactgttatttcaaacttcactcaaaatacactgccttctatgtgctgggacccagagagggtttgtggcatgtttgtaggaataagtccggatcagaacggagctgagaatgggtgttcactcgtattcttcaatgtctcctattgagatgatgttatccacttgttattttcttgaccctattttctgccaagaaataaagtaatttgagagagagagagagagcgagatctaacgtggaaaaacagatctgcaggaaggcatggaacgcactagaaaggtaaaaaatgggctgtttagaccaacactaatagtgtcctttgggatttaaaatatacgaaaacaagagcacccgaggcccggcggaaacacagtctcgctgctgggaggctctggcgttgcttgagccactgcaccgcagactcaatccctagggtaactgctggagtaataatgaaaagtgacactgagaaaaggcaaaaaaagagaaagaaagtaaccaacgacagatgggacaacagagaacaaatggtaagctggtcctcacacacagccagagcaggagggtggcgggggtcagggtctaatggtgtggaggaggaggaggaggatgttgagggtgaagaaacaaagcccatgcccccgagttgtacacttataaatagttaaacagatgaatattatgttgtatatattttatcacaataaaagatctcacatacagccatattggcaaatccattaaaatgaaaatggataaacacacaaagattgccgggctggcgtagagggaaaataaaaccaatcaatcaatatgctgcctcaaagagacattctttctttcttcctttctttccttccttccttcctttctctctttctttcttttttgacagagtctcactctgctgcccaggctggagtgcaatggcgtgatctcagctcactgcaacctccatctcccggattcaagtgattcccctgcctcagcctcctgagtagctgggattataggcgtgcaccatcataccccactaatttttgtattttcactagagacagggttttaccatgttggccaggctggtctcaaactcctcacctcaagtgatcttctcacctcagcctcccaaagtcctgggattacaggaatgagccaccgtgcccggctgcattttattttattttattttatttttgagatggagtcttgccctgttgcccaggctggagtgcagtggcgtgatcgccgctcactgcaagctccgcctcccgggttcacgccattctcctgcctcagcctcccgagtagctgggactacaggtgcccgccaccacgcccggctaactttttgtatttttagtagagatggggtttcaccatgttagccaggatggtcttgatctcctgacctcgtgatccacccgcctcggccttccgaagtgctgggattacaggcgtgagccactgcgcctggcccattttatttcttaaaaacagcttttttttttttttttttttttttgacagagtctcactctgtcgcccaggctggagtgcactggtgccatcttgactcactgcaagctccatctcctgggttcacgccattctcctgcctcagcctcccaagtagctgggactacaggtgcccgccaccacgcctggctaattttttgtatttttagtagagacagggtttcaccatgttagccaggatggtctcgatctcctgacctaatgatctgcctgcctcggcctcccaaagtgctgagattacaggcgtgagccactgtgcctggccaaaaacagctttattgaggtataattgacataaaataaactgcacatttaaagtgaacagtttgaaagttatatctgccaaaccatcaacacaatcgagaatgaacccaccaggccaggcgtgggggctcacgcctgcagtcccagctacctgggaggctgaggtgggtggatcgtgtgagcccaggaattcgagaccagcctgggcaacatggcaagaccccatctctacaaaaaatacaaaaactggccggaactgggatctggaaggcggaggggacgcagtaggcatttgtgcactgtgagtcctggtgtggggccatcgcagcactgccagctcccatcaggtctccctgatcagatgttccaacatgtgtatacagatgtgtacaacacccaagagaaatgagtgtgtatgtgcagcaagacagattcggaaatgttcataacagctttatgccagccccaaactcaatccaaacgcccaagagtagaaagagtcaaatgcggcccattcttacaatggaacgctacctgggaaggcaaagcaatcgcttagcgctactcacggctgcaacagaacaacagtgcagagcaatagcaggcagacgcgagttcgtaccacgtgtgttaatccattctcacactgctgtacagaaatagccaagaccgggcaatttatatagaaaggaggttcaatgggctcacggttctgcaggctgtacaggaagcatggctgcatctgcttttggggaagcctcaggaagcttccaatcatggcgggaggcaaagggggagcaggcacatcagatggccacagcgggagcaagagccggacagtggaggtagcacacactgttaaacaactatcatgagaacagcacccagggatggcgcggaagcattcatgagaaatctgcccccatgacccagtcacttcccaccaggccccgcctccagcactggagattggggcagggacacacatccaaactaaatcacgacacaatctcattgacatgaaattccagaacatgcaaaactatctatgtgtttaaagccaggtttggatgttctctggtgctactctcatcaaaaaaggcggcccacagcgcctctccccttgcatacactggcctcagaggcttgcgtctagtgagcaggctgccggggaagtggcagcacctgatccccaggccaggccatcagatgacgtggcctccgctgggctttctagcttgagatgctccccggagaacccagcctcacaggcacatggaggtgtcctcaccccggcagcgtcctccgctggacacgaaggagccgctgggtggttccagctcgtggccatcgggctgccccggctaaccgactgcagcgggtgagctctgccaactgagacctcacagagcacaggctcgcgagcaaaacaaacattgccattattttcagcccgtacatcttggggtggcttggtacctagcaagagataactggagcagattcatatgtgggtctatgtggtggctgccacatggccgtgtacatataaaacagtcattgggctgtacgagtacggtttgtgtacttttctacctttaacttatacctccctaacaaagtctttcagaaaagcctaactcctgaggctctggtgtgggcagctgggtgggcgctggaactagtcccacacgctgaggtgggaagctcatggtgaaagggaatcccaagtctgcttggccatctaagtttacggtgcctgtgagaaaaatcagaaggccaaaacctcaggagagagagcatgacggaggcgctgccgtttgggaatggacatgatagagccgtgagaatgaggaagatcaccgtcgggaatgagtgcaggcagctaagaaggcgcagaggcgtgtctggagggactcacaccttgtagaggctgggtagagagagcccacgcacgctgagaaagaacacagacttcagcgtcacagaggtcacaagagacaagcggttggtgggggagtaggcaccggcgagagaaagtccaagaggactggatggatttgacaacacggagatccctggtgttctggatgaacgctgattggatggagtggcaggggtagaagcagaggaagagggactgcacagggaatgggcaagtgagaaaacagacaaggattctgaaaagtttagctacaaagaggaacagagaattagggttgtggttggagggggtgttgggtcaaatgagtttttatttttattcttcaagaacggaagctaccaggacatgtttgatgaaaatagatccagaggccgggcgcagtggctcacgcctgtaatcccagcattttgggaggccgaggtgagcggatcacctgaggtcaggagttcgagaccagcctggccaacatggggaaaccccgtctctactaaaaatacaaacattagctgggcttggtgacacatgcctgtagttccagctactcaggaggctgaggcaggagaattgcttgaacccgggaggcagaggttgcagggagctgagatcatgctgctgcactccagcctgggtgacagagtgactctgtctcaaaaaaaaaaaaaaaaagaaaagaaatagatccagaagcaaggaagaaattgatcatgtcgggtgacattatgagtgaagaagtcctcagaaaagaggagaaacttgcaattctggccacagtggaataactgatgccagttgtaaacacctaaaacactgggcaactatttttagatatcggacaataggctgtgcagggctgtgaccagagagaaaacaaagaaggtgagccttacaagtaccctgagtttctgcctggaggcactttcacaccatggttcagcaaaggggcctgagcggaaccagcagtctcactgaattactagagcgaccaagccaatagcagagaaaaaacagaatcccagaaatatgtaattaatccaaaagtcaaaacagatggggtaatagaaaacaaataacaagatgatagacttaactccaaccattaaatggaaatggattaaacagaccaactaaaggcagagattgtcagattgtttaaaagaataaggctgggctgggtgccacggctcacacctgtaatcccagcactttgggaggctgaggcgggcagatcacttgaggtcaggagttcgagaccagcttggccaacatggtgaaaccttgtctctactaaataaaaatataaaaattagctgggcgtggtggcacacacctgtagtcccagctactatggaggctgaggcagaagaatcgcttgaacctgggaggcggaggttgcagtgagccaagattgcaccactgcacttcagcctgggtgacagagtaagactcttgtctgaagaaaaaaaaaaaaaaaaaaaaagccgggcacagtgcctcatacctgtaatcccagcactttgggaggctgaggtgggtgaatcacctgaggtcaggagttcgagatcagactggccaacatgttgaaaccccgtctctactaaaaatagaaaaatcagtcgggcgtggtagcggacgcctgtaatcccagctactcgggagactgaggcaggagaatcacctgaacctgggaggcagaggttacaatgagccgagatcgcaccattgcactgcagcctgggtgacaagagcgaaactccatctcaaaaaaaaaagtaaatatacagacagccagggacaggtgcagtggctcacacctgtaatctagcactttgggaggccgaggcgggcggatcactggaggtcaggagttcgagaccagcctggtcaacatgtggaaaccctgtctctattaaaaatacaaaaaaattagccgggtgtggtggtgggcacctgtaatcccagctactcgggaggctgaggcaggagaatcacttgaacctaggaggcagaggttgcagtgagctgagatagcgccattgcactgcagcctgggcaacaagagcaaaactccatctcaaaaaaagaaaaaaaaaaaagaatttaaacaaggtcacagaatatacggttcatatgcaaaactcaaccgctttttttttttttttttttttttttgaggcaaggtctccctctgttgcccgggctggagtgcagtggtggaatcatggctcactgcagcctcaacgtcctgggctcaaactatcctcctgggtcagcctcctgagtagctcaaactacaggcatgcaccaccatgcctggctaatttttgtactttttgtagagacggggtttcgccatgttgcccaggctggtctcaaactcctggcctcaagtgatctgcccgccttagcttcccaaagcgctggaatcacaggcgtgagccaccgtgcccagcatcaattgcatttctgtataatatcatgatgaactagaaaatcaaagataccatttagaatagcataaaaaacatggactacatcaggaaaaacctgacacgggaagtgctgggtgtggccagcccagagtagtaacaagaccctggacgctcaagaaccctgaagtgtaaggcatcaggaaagctcaaggctttcggtgcaacaaagtccacaagtagagcccgagattgcaacatacgtttttattactcaaggacaacctggacgtcaccaatgcccagcttcacgggggcatgtagtgtgactcacggctgaacacaaaatcactgtgaagcctgtgctacagccctgggctacttttggacacgcaagaggacactcggttacatgaaacctgacttgcttctgaagacatgtgatacatgtcttttccctgaaaatgtttcccttccctgtctgccatgctcccaacttttctgccttccaggggcttctcactgtctgggtaactaggtcttgggcctagctagaccttgggtagtggcccctctgccacaatcagtgcctgggcctgaggctgagcttgtggcctccgaagcctgacctggctcggagctcgtctgtggcgcccagggatggcctggcttgcaggccaccacattaggccagctcgcaggtccccagtaaagcctgaagacactggcccgaggttggaggtgggtgctgctcgactttctggaggatctcagaattctcgcttcttgctaggactgaaccatgagacttacagccatacttcacttttcccagggtttttctttttgaaacagggtcttgctctgtcacccaggctggagtgcagtcatacaatcatgactcactgcagcctcgacctcccaagcataaatgatcctcctacttcagcctccccagcagctgggaccacaggcgtgcgctaccacgccaggctaatagtttaaaaaattttttggcagagacagggtctcatcatgttgccctggctggtcttgacctactgggctccagcgatcctcctgccttggcctcccaaagtgctgggattacaggcgtgagccaccgcacccggccacacttttccaaattgtaagcaggtaggagggccctaggcctcgtcggccccattgtgcagggtggccactgtccaaagagatgggcaaagagctgctgccagaggcctgggctgcagacgccctgcatggctctcaggggagccagctccctactccacacccctgcacagcagcccctctcctcccctcacgggtctgtgcagccagcagcctcccaacatgcgccagcctcctcactggatgatgccagccttccttgcccccagatgctggcatggaggcagggttccactctgcctgcctatgcccacagagcctagaacagcagggccacctccttctctcccccgcgggcatgggcccccacccccactgccggcagagtgctgaggactcgtgcaccatgagaacttctgaccatgagaactttgacttccggatttgggggatctgcccaggtgaacacatcagctctgaaattcatcactttcttcgggcccctgcctgtcctgttccaggcccaagcctacagaaggaagaggaaagtccgcttagcaaatgggggaggctcccctactgccagaagccctggctcaaggcctgggccatgctcccttatctcctggggcgttcgtgggaattgagggtttttgtttgtttgttcatttgtttttgagacagggtctaactgtctcccaggctggagtgcagtggcttgatcacagctcactgtagcctccacctcctgggctcaagtgatcctcccatcttggcctccaaaagtgctggtattataggcatgagccacctcgcccagctgagggttcctaagcagtggttcttcaaatagtacctgggatggaaaattcctgctggggcttcctatttcctgaaagcacagagtggggcaggcaccctcgggctaaaggaggtgctactgtcaggaggcgagggaaggagtgggccagggtcttgctaagggaggcatgtggggccggctgggcttctagaggtcgccagagccagtggcctgcccggctgccccacgccctcagcgcagtcgggacagacactctgctctttggggctgacacggatgcgcctgagcaccccagaggccagcctgggcggcagcacctgggagggagctggacgacagcagctgcaggctgtccagggccccatcctcgtacagggccagcttctggaccatcttctgtcgggcagggttgatgataatctgcggtggctctgacgacgatgatgcagagctgccaagggccagtcctggggtggagatggcactcccttagcctcatgctgtggctccccagcccgcagcctagcaccctgcctccctggcctcaggcctgaattcctcagagaagtccaagggcagggcccagctctcaggctaccagacagagccctccttgttcccagccttcaggaatggggtggggggagggctggagagcaagctccacctgggaaggatgtggcctggggaggggaaaccagggttgctaaggtcacagtgagctgaacatttggccctggttctcttctagaaggctggggtggggacttacaggggctttggcccaaagaggccttggtccctctcctgggaacccgtctccccagctaccttccacggctgtgggccgggatcctgggccactcccccagctcgattctcctgccgtgtccccctgaggacagccggcctccctgaggggtgctgggtccagagggcagcttggagtcaagtgccaggagcgcagggcagcagagaggccgcctaggctctcgtcactctccacgggctggttggggcctctctgcagctgctctgctgcctgggcactggctcctgatggcgctgccaggggctgccatggagcagccccactgtgggctctgccagtgctggacacgtaggagttctcctgcggggaaggggggatgcagctggcggcctccgaatgcccgggcacccccgccaccactgcctgcagcttctctagcctctcgtacacctgcaagtggaaaagagggactctcagggtgagatggcagccctggccggtcaccccgtgggcaaaccacagggctgctccaggccgtccgtgacctgccccagggctctaaaatgacataccctgcagctgggaacgctctgcccctcgcccctctgttcccatcacagggagtgctgagaagcgcggctgccaaaagcaaggactgagaatggcctcgttcttttctacaaaatgaatctcactgccccgctgccctcaaacggggcctctccattttcaactgtcaccagaggagaagaggtggggtactagggaggggacagaaaaaggcagatgcagtagtgcagtgcgcccagcagggggcgcggcagcagctctttccttctctctatgtgaagggggtcggagctgggctccgcaaagcaggactgcccggggcccctcagttcagaggggcgctgccccaaacagaaccaaagggcaagcaagaaatgtgtggagactccagagagacctagcaggtgctgagatggggtcactacagagcaaggcctggaatgcgggctttctatctggccaccccgtcccagtgcgcagctggctacctgggtcataggaggcctccttttggcccggcggtgcaggcagcagcaggccagctggcccaggcccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcggacactgactcacttccccttcgagccggcctcgtgcgacgcccggcggggcggaaggggcggtgcccgggcccgccgccatcttgcgcgccgcggccgcgcgctgggtcacacgggggcgccccgcgccggggagggcccgggtcccggcgggttccgcgagcggcgatcggcctcccgggctcgcccgggcggggctctggaggacgaacggcggctcccggcgttggggacagagggcagggcggaggcccgggctgctcggaaaggggccggggccgggccttccgaaagctcctgggcggccctgccggaaccctgctctccactgcggcctgcagggctgttaccaggagccctgcctgcccgccccacgtctagccccctgcacacggcagcagccttgagccattcagtctccttaggtgtcctgaaatatgccgagaacgctgcccgccacagccgtgagtgtatgcgttgctgctgccccagccctcatttggcaagggtgagctcaggcagctgtggtgaaggcttcctgagcccgccggcagagctcctgccaccccgtacctgtcccctcctgggcatcgtccttgattacttgtctggaccgccacccccggtccccgccctgagatggggaagaccccacaagcagcaacgcagacttactcttttgtttctccagctggatgtctcctccagcgacagttccccttgccctcttgatcctgacagcgaaggggttccccacccctagccctacagacttaggacttttcctagaaacgagaagtgcccaaggcccacagctggcccctgttggagtctctttcctgaagccaccaccactgtggccactcccaaggaagatgccaaccataccatgaaacccatggcttctcacgggacagactttactgagatgtaccaactcaagtatctgaaatgactgcacacccatgctaacctccacgggggcacttggtcctacttacacacaaaggcccatcagctcacggaacagggctggcatacgagatgctcaatgcatacaagttgacttttcaaccctgggatctacctttgaaggccaggccttccgagggtaccttctagcatgtgcatgtgaagctggactcctttgagcagttgtctcctccagccccttaccaacctggtgaggctgctcctgagagccaaggaagccagtaacaagggggccccctttgggcaaacccctcagcctgcccttgcctggtcagagaaccacgttagcagtcaacagagggcacgtgagggtcctggccagaatgagacacaggaggagccacagcctgcgggggtgggggtgtccaaaagcaccacagcacatccagacctagggggtgcccctaccatacgggtctggagcagggaggttgtgctgcaggctgactcatgccaggcccttcccgtcacacgctggagcagtgtgcctggagagcactggcttggaagaagctgaggggccagcgaggccagcatatggaggaggcttcccttggccgctcgtggcaggcctgaaggcagctacctgtgtccagggacagccagatc

SEQ ID NO: 970 - DNA, 554 bp, Homo sapiens
  Genbank Accession No. U52969
gccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaaaaa

SEQ ID NO: 971 - DNA, 1974 bp, Homo sapiens
  Genbank Accession No. U53225
  unsure (1)..(1974): n = a or c or g or t
cgggatcaatttgatttgacagtcggtataactgatcctgagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttytcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccntgtccccacgaccaactgtccccagttactctaaccgttatttcatttagctnccatatatattttcttacctaagagaatagtttcctgctttaagnaaaagacctacaataggtggtggaattatgggatggggtggagtattgatataaatatataaatacaaatgtatatttttcaggatgtggtttaggaactgggaataacgttttcatggcaccatcaggagtaacagaaaacc

SEQ ID NO: 972 - DNA, 3025 bp, Homo sapiens
  Genbank Accession No. U53445
gcacgagcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtctgcaaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttgaaaaaaaaaaaa

SEQ ID NO: 973 - DNA, 4050 bp, Homo sapiens
  Genbank Accession No. U55209
cggcaggagagagagggagagacaagagacacacacagagagacggcgaggaagggaaagacccagagggacgcctagaacgagacttggagccagacagaggaagaggggacgtgtgtttgcagactggctgggcccgtgacccagcttcctgagtcctccgtgcaggtggcagctgtaccaggctggcaggtcactgagagtgggcagctgggccccagaactgtgcctggcccagtgggcagcaggagctcctgacttgggaccatggtgattcttcagcagggggaccatgtgtggatggacctgagatcggggcaggagttcgacgtgcccatcggggcggtggtgaagctctgcgactctgggcaggtccaggtggtggatgatgaagacaatgaacactggatctctccgcagaacgcaacgcacatcaagcctatgcaccccacgtcggtccacggcgtggaggacatgatccgcctgggggacctcaacgaggcgggcatcttgcgcaacctgcttatccgctaccgggaccacctcatctacacgtatacgggctccatcctggtggctgtgaacccctaccagctgctctccatctactcgccagagcacatccgccagtataccaacaagaagattggggagatgcccccccacatctttgccattgctgacaactgctacttcaacatgaaacgcaacagccgagaccagtgctgcatcatcagtggggaatctggggccgggaagacggagagcacaaagctgatcctgcagttcctggcagccatcagtgggcagcactcgtggattgagcagcaggtcttggaggccacccccattctggaagcatttgggaatgccaagaccatccgcaatgacaactcaagccgtttcggaaagtacatcgacatccacttcaacaagcggggcgccatcgagggcgcgaagattgagcagtacctgctggaaaagtcacgtgtctgtcgccaggccctggatgaaaggaactaccacgtgttctactgcatgctggagggtatgagtgaggatcagaagaagaagctgggcttgggccaggcctctgactacaactacttggccatgggtaactgcataacctgtgagggccgggtggacagccaggagtacgccaacatccgctccgccatgaaggtgctcatgttcactgacaccgagaactgggagatctcgaagctcctggctgccatcctgcacctgggcaacctgcagtatgaggcacgcacatttgaaaacctggatgcctgtgaggttctcttctccccatcgctggccacagctgcatccctgcttgaggtgaaccccccagacctgatgagctgcctgactagccgcaccctcatcacccgcggggagacggtgtccaccccactgagcagggaacaggcactggacgtgcgcgacgccttcgtaaaggggatctacgggcggctgttcgtgtggattgtggacaagatcaacgcagcaatttacaagcctccctcccaggatgtgaagaactctcgcaggtccatcggcctcctggacatctttgggtttgagaactttgctgtgaacagctttgagcagctctgcatcaacttcgccaatgagcacctgcagcagttctttgtgcggcacgtgttgaagctggagcaggaggaatatgacctggagagcattgactggctgcacatcgagttcactgacaaccaggatgccctggacatgattgccaacaagcccatgaacatcatctccctcatcgatgaggagagcaagttccccaagggcacagacaccaccatgttacacaagctgaactcccagcacaagctcaacgccaactacatcccccccaagaacaaccatgagacccagtttggcatcaaccattttgcaggcatcgtctactatgagacccaaggcttcctggagaagaaccgagacaccctgcatggggacattatccagctggtccactcctccaggaacaagttcatcaagcagatcttccaggccgatgtcgccatgggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatgctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcagggcgacctccgcgggacttgccagcgcatggctgaggctgtgctgggcacccacgatgactggcagataggcaaaaccaagatctttctgaaggaccaccatgacatgctgctggaagtggagcgggacaaagccatcaccgacagagtcatcctccttcagaaagtcatccggggattcaaagacaggtctaactttctgaagctgaagaacgctgccacactgatccagaggcactggcggggtcacaactgtaggaagaactacgggctgatgcgtctgggctccctgcggctgcaggccctgcaccgctcccggaagctgcaccagcagtaccgcctggcccgccagcgcatcatccagttccaggcccgctgccgcgcctatctggtgcgcaaggccttccgccaccgcctctgggctgtgctcaccgtgcaggcctatgcccggggcatgatcgcccgcaggctgcaccaacgcctcagggctgagtatctgtggcgcctcgaggctgagaaaatgcagctggcggaggaagagaagcttcggaaggagatgagcgccaagaaggccaaggaggaggccgagcgcaagcatcaggagcgcctggcccagctggctcgtgaggacgctgagcgggagctgaaggagaaggaggccgctcggcggaagaaggagctcctggagcagatggaaagggcccgccatgagcctgtcaatcactcagacatggtggacaagatgtttggcttcctggggacttcaggtggcctgccaggccaggagggccaggcacctagtggctttgaggacctggagcgagggcggagggagatggtggaggaggacctggatgcagccctgcccctgcctgacgaggatgaggaggacctctctgagtataaatttgccaagttcgcggccacctacttccaggggacaaccacgcactcctacacccggcggccactcaaacagccactgctctaccatgacgacgagggtgaccagctggcagccctggcggtctggatcaccatcctccgcttcatgggggacctccctgagcccaagtaccacacagccatgagtgatggcagtgagaagatccctgtgatgaccaagatttatgagaccctgggcaagaagacgtacaagagggagctgcaggccctgcagggcgagggcgaggtcctgcaggcccagctccccgagggccagaagaagagcagtgtgaggcacaagctggtgcatttgactctgaaaaagaagtccaagctcacagaggaggtgaccaagaggctgcatgacggggagtccacagtgcagggcaacagcatgctggaggaccggcccacctccaacctggagaagctgcacttcatcatcggcaatggcatcctgcggccagcactccggtcagtgccggaaagtcttttggtggctgagtggtgcctctgtcaacctagcaagagattaagccaagcatggcctgggtttggcttcgctgctagctagttggtggagttaggaccttggtggagttatttcatctttctaagcctctgattccttgtctgtaaagggggaatcctaaaacaggcatcccttggagatattgcaggttcagttgaaggcaacagaaataaatatcacaataaagagagctgcagaaataaaaaaaaaaaa

SEQ ID NO: 974 - DNA, 2093 bp, Homo sapiens
  Genbank Accession No. U57316
gaattccggcgaaaccactcatgtctttgggcgaagccttctccggtccattttcaccgttacccgccggcagctgctggaaaagttccgagtggagaaggacaaattggtgcccgagaagaggaccctcatcctcactcacttccccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagcccggaattc

SEQ ID NO: 975 - DNA, 9170 bp, Homo sapiens
  Genbank Accession No. U57623
atcccctgagccccggagtttgaggctgcagtgagctatgatggcgtcacagtactccagcctgggagacacagcgagagactttgtctctaaaaaataataataaaataaaaagttcaatgaaacaatacacccaaagccctcagcatgcaataaatagcaagacaaggcaggtcttatttttactgaaagtgcttagtaaactatacagtgacaaaccaccgcacaacaggctctcgaaaggaggcagcaaattacccaaaagtgcaggcggcttgctagtgtgcacaggccaaagaaagggcggcaggtggggaaggcagccatgggccttgaagagctgaccgaattggcagaatttctgcaggaggggagctgggaacgacctgagctaaagctcggagctgtgcgaagaaaccggaaaagcccagagcacttgcaggggcgggtggggagctagatggtggggtggggtggggacggaggagggccagcaggagacattccgcagggaggggcaagcacgtgtgaggcgggcggggcgcgaagggtcaggcttttgctcaaaacaggcagaggacaaggtcagctcagccgcagaccgagccgctggtgactgtctccgccaccaggcagtgagagtgaagggagagcgcgacctctgaagcccgctagactaagcttgcaatctgagctccattcaccccctcctatttcttgagaccttgtcagttcccctgtgagcctcggactcacttgtaaaacgaggacagatgcccgtgccagaagtcaaccagagctttccccggcgtgggcaccagcccaagggcgttttgttttctagtctcatctctgctctgacgctaagctcaaagagggactgggggacgggaagatatccaccatggatgcgccctagatctcgggctggtgtcggctgttccttctcagattccagagtgtctagaggccaggaaagggagaaggtcctaccagcctggggtagggactcgggggccaggcactggcgctgacgcaggctagcagggcgccactggctggtccccacccacctcggtgggttgggggatgggcgcaccagcccctcctgggtgagccctagcctggggcttcctatttcgggagccgggggcgtgggccacgtctcctcatgtgatgcgagggctatttaaagcggcagcccgggcagggagccgccgtcggagcccttgcacgcctgctctcttgtagcttctctcagcctagcccagcatcactatggtggacgctttcctgggcacctggaagctagtggacagcaagaatttcgatgactacatgaagtcactcggtgagcaagccgcggggctcaggatgttggcttggggactggctggtggcgtgcctagccccacgcagcactcctgccgcatccctcctggttaagactggggaataggggagcgcggagatggcagcctggcctagagcaggtggggcctgttcagagggggctttggtggtccaaatctggttagagaccacggtagggaggtggtggaaggaggcagctgtgtgggaggctctttccaggaagagggatatgtgatttggaggtaggaggagggtttggataaagaacactgatcacaggaaagggagtgtagccaggggagaaaaagaacaggggcatgggtagtttagaaattggaggagactgaacccagaaagggaatggggcagccagggagtgtacaatgatgtaaacaagtaggaaatacctaggaggaaaaagattagtggggaaaaaactgtggatcagtgaatcagatatgagaaggacgtaagacaggaacctgcagtaagcagcaatccccatctctgcttggttagggaagagaattcttgctggagaatgccctttctcaccagccagtctgaccttgtcctgcagtctatgtatccaggccttcatcactgtctgtgagcctcgtggtagggtggggcaagaggcccatgatcagctgggcctttcctgcaacccaaggctcacctatctgtgcgaggggtaggcagagaaagccattggacttctgatgtgcagtagagggtcccaaggcaaggtcaagacctgggagggaggatcactggtttaggaggatgtggagaactcctgtggtgttgggatggagaagaatcaggattcaaagaatctcacaggtgaggaacttggagattcccataccatctagttcaacagggaaactgaaaccaggagagtagaaatgtattataacaattccacagcagagccaatatgaaaatctaaggtttctagatctgtaacccagagctcttcccactaccctacaggccctgcgagtgggaagaaaagtagaaactgcttagctaatgattgacctcagcccttcttctactgctttgggcttagatggagaggtcaaagctctcaacggcctctaccctatcttgggcgctatgcccagtaattctaggcaggcagtcattcttagaggagcagcccccagcccccacgaacacagcccagcagctattgggaagttggaatgcccagatttagttcctccttccaaagctgggccagagctgagtcttgaattgagctgcaacaactttaccattcttgttcccttattctgccccgagttgggtcagcgggctggtctccctgaagtcctgttatctttcagcagcttatgttaaggcagccagcattctcatcgtaggaatggaaagcctgggaaaataccctcctcagctctcagtaagtagtgctggcttcatttctaagtagaacccagatctccctgagtctcctaaattctgtcagctcaatattcttagtttctcttggttcagaccctcactcatcccgcagtggtttccttttcaaacactccatacctctgggtagatcctaagtgaacagagctcccagtgccgtgacaaggtcctgctctgtgcaagggagtgtgattggcctgactcatcctgataccaaggggcaatgccaagttcctcactggccaagcaagggtgggctgacagcataacagcagaggcagcccctgcccctcctgctgtagacctagggctctcaaggggcaaagaggtcccgtctagtaccagtgaccacaggcacaactgctggcctggattgagtatgtgctggacagaatcgcccagtgaaaatagtcaacagttttggagccgaggttcaaatctatgtcagtagtttattctctttgaatttcgacaagacacttcgcactcttcattgtaaactggggataatctacgcttcgaggctgttacaagcattaagtaaaacaacccatgtagggcatgtgcagagtacctagcttccagcaagcactatgtagccaggtacatttggagactttacacacaccacctcactacactgggctgcctcctgcctcacctttgccttggaagacagttcaatgttaagctgctggggggagagggggcagtcatgattagttctttgttctttacttggttgcaggacacttaggactttgcccagtacccaaggaagccatgcttgggtcaggaagagagtctctgtaaagccttagactgggagtcaggagacgggtttgagtctaactcattgttgctaccgctttaggctcctcctgaatctgcacaataggacaaatacttcctttgtacctaactcctagatcatagataacaggctttgaaaatgatgggttgccatgtataagggacaagagcactaacacttcttagtttcagggtaaaaacttccaaagttggaaaactcctatgcctaaggctttggaagggaaagtctatgtttctcttctttcctcagccttattcctaaggctttgagagcttttcaggtgccctggaaggcagccttatgctccagccttgggaggtagtatagctgagcacttaagcaagctctggactcagacaattctgggcttcaatctcagatttgtgaccctgggctttacctctgtttttgtatctgtaacgtggaaacagtcttcagaagaacaggaagaactaaatgagataacatgtacagttcttactacacaaaaagctcatagtacttaatagtagctttttttttttttttttgagatggaatctcactctgttggctaggctggagtgcagtggcacaatctcgactcactgcaacctccacctcctaggttcaagcaattctcagcctcagcctcctgagtagctgggattacaggcacataccaccacatctggctaattttttgtatttttagtagagacgggtttcaccatattggccaggctggtcttaaactcctggcctcatgtgatccgcctgccttggcctcccaaagtgtgattacaggcgtgagccaccacacttggcccaatagtagcttattctaatcccagctctgccactgacttgctatggcactgctgttccttaagtatctctcatctaatgggatcagttatctgtgttcaccaaacagaactaagcgcaagactgaattttaaaattcccatgcaaaggctttgaaagatacagtcctccacttccccatacccaggcctgagagttattcattgagtttcttgtacactgcttctctaccccagctcatatactcataaccttccccctaccctcaggtgtgggttttgctaccaggcaggtggccagcatgaccaagcctaccacaatcatcgaaaagaatggggacattctcaccctaaaaacacacagcaccttcaagaacacagagatcagctttaagttgggggtggagttcgatgagacaacagcagatgacaggaaggtcaaggtaagtcagggaaacaggggtggggaatggagagtgctgagactctaaaagagaataggctggtagtcttggctccctggtattgcaccctgaggggcagactatcatggggaatttacatgaaacaagattcataaagcctgtgtagtgctggaatgccactgatgctaaatacatgtcagttctgtcctcttgttttcttccctcccttcttgggattcatctattgtctgcctcggaatgggcagcacagagccaggatgttcttctgacctcagtatctactccagctccagctgggtgaccctgtgcaaggtatgcagtagctctaggtttctttccccttccatagatggagagttatgtggccatggctgtgacctgaagtgctttaggaatgatgcccagaagtcagggccctccactgagtgaggtcattgtgacctccagcagcaaaaaaggcagccaggaactagaagcacctactcagatgccgcttcaacttctaactcccagacatggccaatgaccctgacaaactatttccagtgttgccagctgacaggcaggaaagagctatgttccgtgatagggcattcaccttgtcatgaatgtgtttgcagtgtctcccaccaagccttagcccctcctcccagggttctatcaccctgcagtggctgtcttggcagcttgcctcagccttccaggccaggcatgggagcgagagaacttaagggctttgacctctatagggtgtccctatagcagtgttctatcatgacactatcattcagccccatcagctgtttcctcttcctcatagctgtccccagaaagaacaggatcacacaggtggctggcagcagagctggggatggtgcccaaagatggcagtctaccttggataaaggtggctgccccaccacctgctcatacctccttggacttgcctactttctcaaggggcaagaaccccaattaaacacaatagccctgtggaatgcctagggcaaaaatatctactctgagtaggcaaaaaaaactaggggaatgagaacaaggagtaaggtaaggataaaaaagagcacactaagagacaggcctcataccccttatcacctaaacaatacacagaaccttctcagattctcctactgaaccaccttgctcatcaggatcccttagcctggccttgtggcccccaaactcctaggaaagagagctggaagagctgccaaatgagaaccagctgatgtatgtatgctggcagcacccagagctgaggaaccacttcaagggcatccagtcacaggactttgtggttgctgccctcttgttggctaaagaggtcacatgatgtggaccaagaaaaggtgtaggaatacagggcaggaagtctaattatccaatacttcctatcactaagggtcttttagacattatgtggactaaccacaaggctggataaagattctcaggactactcctcctcctcagtcagtctttcccagggatagactagtaaatcccacctgtatctgaggggaccaggctacgggaatcacctagagtacagataagtgtctgtcttgaaggcttgtggtacttctcagagccaggctctctggctccaccatactgcctgcctctccctccttgcctaatatctgaaggcctcttccccagaaaggcagtagtggagcagaggctggaggtgaactagatgtcttgcagggatagctgggaggcggattgcctgagctcttgtcctcacaccatcactagtttgggtcaaaggctgtgtcctctgtggcccagtgtccagaccccaccctgcccctcaattcctgactaagatcacagctcaggcctctaccctctttccacagtccattgtgacactggatggagggaaacttgttcacctgcagaaatgggacgggcaagagaccacacttgtgcgggagctaattgatggaaaactcatcctggtaagatgggcaactttggagctatatctgattggttattactactgctctttcagccaagcctgttctaaaaagccaagtcctcccctgagagctgtagaagctgggacaagagagtggttgtgggtcagggtggtatcaggtgggaatttttctgtgtagtggctttggactcacacaggccggaactcaaatcttaccttataggctacatgactgtgggcaaatcaccttttccaagtgcaactgtaaaacgggtattaataataccaaccttgtagggctgctgggaagcctgtaagagacagtgtatgcacagcacaaagcatcactgattgaggaacacagcaggtgctccatgtcctttgtttgctcttcctgtgtttctaccttgcctcacctcaggaagaagtagaaaacagggccaaatctgatcccaggccctctaggaggggctcccattgcctatctcagcattccctttcctctcctccctaggactgcattgtcacttgcagggacaggctcgtgactggtggggacactgaatgacagtacagtcctttcttccccattctagtcctaccccattttcatgctttctatgtctggcctactgaaactacttgactactgcttgggtaggaagtaccacagccaggctggcagatctgttcaagcttggggacttcacttggagaatctagccttgactgaattccccccagacccagggagagcagccaactgtggattctgcctaaccacagggcctcaggttttcacctaggcatcttcactgcacaccttcttgggtcagcataacctgttaactgcattcttgtactcatgtgggacaggggtccccttgaagtttggaatgaggtgcctagctttggtggggatgtgatatgcaggaccaaattctcagtggcagctgaactatggtgaggccatgggtctggctctatgatgccagaccggatagtgggaggtacagggctctggccctggcactactctaagttagggaaggattggagttagtacccaaacacagtcctttcctgagtctctggatatttttcctatttgtcaactatatgccaggcaccatcttagacactaaggatgaagaagccaaatggtataagggaaggaaaaacactcaggtcttgaccaaattacttcctctctaaaggctcgttttttccaaatctctaaaataagaattacaatgcctgtcttaaggatttgctgtgcatatcagaaaaaaaaaattatgtatgtatacacacacacacacacacacacacacatacatacttgccggcactggtaggtctcagtgacaattatcaggaggaagggagggtagaatgctcgcaatggtgttcctggctcccaccccccatctcactctgtctttccttccagacactcacccacggcactgcagtttgcactcgcacttacgagaaagaggcatgacctgactgcactgttgctgactactactctgccaatcggctacccctcgactcagcaccacattgcctcatttcttcctctgcattttgtacaaatccacgaattcttctggggtcaggtgccactgaccgggatccagttccagttcccatggtgtatgtggttttttttttttttttttaactgcactcatagggtgctctgaggtcaataaagcagagccaaggccacccagttgccttttggcctttggtaacataactctgggagtcttggtttatcctgtgtgtcagagagtgggcagaaataacggcctgaaggttactgaggaagaagcactggatgggagactgaaatggacagtctcggagcctgttaatcagctgatcaccttacacatttaataataaaagagctgtacctacacgttgcctttacactgccccccctccatggtcaaatgacctagttcagtcagtgatggggcttccccaggtttggctattgaactgtcacttcaggcccatcctacactgaaagctcttgggtctggctgttctctgtgaaatgctgtagtctctccctttccagaattcaggttcagggcacagaacccaggcttgtaccatggtggtgggagaaaatgaccactggccaagaggactgctgacctgtgcaccaggctagtacttatgactacaaattcttactgcttctctaatcaactctgagggaagagggcatctgatcattacaaaagggagggcttataagtgat

SEQ ID NO: 976 - DNA, 2149 bp, Homo sapiens
  Genbank Accession No. U58522
  unsure (1)..(2149): n = a or c or g or t
gacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaatctggcattctcgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggatttggttgaataattaagataatatttggagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcacccccccccacccccgccttggcacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttccaaaagtttgaaaattattagttttgcaagatcacacactaatgtaaccattttatgaaggttgaagtggatttatgcaggcagttctatatatagaaatncaattctttttaaatttttaggaccaatacaaaataacacaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgtcgacgcggccgc

SEQ ID NO: 977 - DNA, 6981 bp, Homo sapiens
  Genbank Accession No. U60975
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcggaaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaaaaaaaaaaaaaa

SEQ ID NO: 978 - DNA, 2016 bp, Homo sapiens
  Genbank Accession No. U62015
ggcacgaggagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 979 - DNA, 747 bp, Homo sapiens
  Genbank Accession No. U65579
ctggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccacggaaaaaaaaaaaaaaaaaaaa

SEQ ID NO: 980 - DNA, 2897 bp, Homo sapiens
  Genbank Accession No. U66075
ggaattccgcgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggtggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtgccttcatcacggcggcttggattgtcctgtgccaactgtcacaccacaactaccaccttatggcgcagaaacgccgagggtgaacccgtgtgcaatgcttgtggactctacatgaaactccatggggtgcccagaccacttgctatgaaaaaagagggaattcaaaccaggaaacgaaaacctaagaacataaataaatcaaagacttgctctggtaatagcaataattccattcccatgactccaacttccacctcttctaactcagatgattgcagcaaaaatacttcccccacaacacaacctacagcctcaggggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcggtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaattttttttttgaatgggatgtcctatggaaacctatttcaccagagttttaaaaataaaaagggtattgttttgtcttctgtaaaaaaaaaaaaaaaaaaaaaaaaaaaaaaaaaaaaaaaaaaa

SEQ ID NO: 981 - DNA, 5190 bp, Homo sapiens
  Genbank Accession No. U66615
ggaattcccgcgaggccggggtgggccaggctgtggggacgacgggctgcgacgatggccgcagcggcgggcggcggcgggccggggacagcggtaggcgccacgggcttcggggattcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacagctatcgtctaaacccccaagagtatttaactagcactgcttgtcggaggaacttgactggagatgtgtgtgctgtgatgagggtccatgccgggggagagcagtggggactcgttaattaccaagttgacccggaaagtagacccatggcaatgggacctcctcctactcctcattttaatgtattagctgatacccctctggcttgtgcctctgatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagaggatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcagtagtacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagggctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccattttctctcttccagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatatttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatatttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggaggaccttggtccttttgtttttgttctggactcttgggagtggaaatgggatgagtttatccactggagcttaagtcccatgcatttgctccagaaag

SEQ ID NO: 982 - DNA, 3496 bp, Homo sapiens
  Genbank Accession No. U69263
cgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacggatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggtgggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcctttttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtattggactttaccttgatatatgtatatggatgtatgcataaaatcataggacatatgtacttgtggaacaagttggattttttatacaatattaaaattcaccacttcagag

SEQ ID NO: 983 - DNA, 2717 bp, Homo sapiens
  Genbank Accession No. U72649
cagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaaaaaa

SEQ ID NO: 984 - DNA, 1366 bp, Homo sapiens
  Genbank Accession No. U75272
cgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgctgcctactttggtgagatcagcatcgggactccaccccagaacttcctggtcctttttgacaccggctcctccaacttgtgggtgccctctgtctactgccagagccaggcctgcaccagtcactcccgcttcaaccccagcgagtcgtccacctactccaccaatgggcagaccttctccctgcagtatggcagtggcagcctcaccggcttctttggctatgacaccctgactgtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaaccagcagggctccagcgggggagcggttgtctttgggggtgtggatagcagcctgtacacggggcagatctactgggcgcctgtcacccaggaactctactggcagattggcattgaagagttcctcatcggcggccaggcctccggctggtgttctgagggttgccaggccatcgtggacacaggcacctctctgctaactgtgccccagcagtacatgagtgctcttctgcaggccacaggggcccaggaggatgagtatggacagtttctcgtgaactgtaacagcattcagaatctgcccagcttgaccttcatcatcaatggtgtggagttccctctgccaccttcctcctatatcctcagtaacaacggctactgcaccgtgggagtcgagcccacctacctgtcctcccagaacggccagcccctgtggatcctcggggatgtcttcctcaggtcctactattccgtctacgacttgggcaacaacagagtaggctttgccactgccgcctagacttgctgcctcgacacgtgggctcccctcttcctcttgaccctgcaccctcctagggcattgtatctgtctttccactctggattcagccttctttttctggactctggactttctctaataataaatagttcttctaaaaaaaaaaa

SEQ ID NO: 985 - DNA, 2685 bp, Homo sapiens
  Genbank Accession No. U78294
caggcgtgtcccagggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaagctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggatgccttcttcgcctcccagttcctgaatggtctcaaccctgtcctgatccgccgctgtcactacctcccaaagaacttccccgtcactgatgccatggtggcctcattgttgggtcctgggaccagcttgcaggctgagctagagaagggctccctgttcttggtggatcacggcatcctctctggcatccagaccaatgtcattaatgggaagccgcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatttggggtgcagtggaacgctttgtctctgaaatcatcggtatctactacccaagtgatgagtctgtccaagatgacagagagctccaggcctgggtcagagagatcttctccaagggcttcctaaaccaggagagctcaggtatcccttcctcactggagacccgggaagccctggtgcagtatgtcaccatggtgatattcacctgctcagccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgtttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaaaaaaaaaaaaaaaaa

SEQ ID NO: 986 - DNA, 1192 bp, Homo sapiens
  Genbank Accession No. U85625
cggcgactgaccgtggtcgtgggcggacggcggcttgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcag

SEQ ID NO: 987 - DNA, 848 bp, Homo sapiens
  Genbank Accession No. U89922
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 988 - DNA, 3452 bp, Homo sapiens
  Genbank Accession No. U90552
ctgaagcttgcatgcctgcaggtcgacccacgcgtccgcggacgcgtgggcggacgcgtgggtttttcctttcttccagaaggagatttaaccatagtagaaagaatggagaactattaactgccttccttctgtgggctgtgattttcagaggggaatgctaagaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcagaccccttcttcaggagcgcccagaggtggatcgccgccctggcacggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagagtgaagctcctggaggaactcagatggagaagtatccagtatgcatctcggggagagagacattcagcctataatgaatggaaaaaggccctcttcaagcctgcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgagtatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctttgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattttctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctgaaaaaaaaaaaaaaaaaaaaaaaaaaaaaaaaaaaa

SEQ ID NO: 989 - DNA, 1909 bp, Homo sapiens
  Genbank Accession No. U91903
  unsure (1)..(1900): n = a or c or g or t
cggagacggcggagcgggccttgttggcgtccactgcgcggntgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggacaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtcccaaaaaaaaaaaaaaaaaaaaa

SEQ ID NO: 990 - DNA, 716 bp, Homo sapiens
  Genbank Accession No. U96094
agacagcctgggagggagaaggagttggagctcaagttggagacagcgaggagaaacctgccatagccagggtgtgtctttgatcctcttcaggaggtgaggacaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaagtgtttgccagggaacggtagatttattccccaactcttaactgaaaatgtgttagacaagccacaaagttaaaattaaactggattcatgatgatgtaggattgttacaagcccctgatctgtctcaccacacatcccttcaacccacacggtctgcaaccaaactctaattcaacctgccagaaggaatgttagaggaagtctttgtcagcccttatagctatcatgtgaataaagttaagtcaacttc

SEQ ID NO: 991 - DNA, 159 bp, Homo sapiens
  Genbank Accession No. V00563
ccggtaaacccaccctgtacaacgtgtccctggtcatgtccgacacagctggcacctgctactgaccctgctggcctacccacaggctcggggcggctggcgcctgtgtgtgcatgcaaactaaccgtgcaacgggtgagatgtgactcataatagata

SEQ ID NO: 992 - DNA, 372 bp, Homo sapiens
  Genbank Accession No. V00594
agtcccagcgaacccgcgtgcaacctgtcccgactctagccgcctcttcagcacgccatggatcccaactgctcctgcgccgccggtgactcctgcacctgcgccggttcctgcaaatgcaaagagtgcaaatgcacttcgtgcaagaaaagctgctgctcctgctgccctgtgggctgtgccaagtgtgcccaaggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaa

SEQ ID NO: 993 - DNA, 3565 bp, Homo sapiens
  Genbank Accession No. V01512
gcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagt

SEQ ID NO: 994 - DNA, 448 bp, Homo sapiens
  Genbank Accession No. W02204
  unsure (1)..(448): n = a or c or g or t
ttaaagtaaaataccattgggattcacagtttattgaaatttaataaaaattatttccaaagaatgagaatcctggggtagcgaggcaattaattaagcaattcatcttaaaagatggaatacttggaacaccttagccatcattcaatgccaaaatgtttgggtttttttcatatcacatccgtcctatcttttcatcttcagtgaatcattcctcatgtttgtaattaaagccatatttaccatcataatctgcagtcacccgagctcattttgctctgaagccagtgatattaagctgttctatttctaacgtgtcccttaacttgattctaagtaaaagcagcaagcagtgggtatttaatatacaaactcatcaaattccacataanacatttaaccacagntttaaaaactccagtggcctttacactagctaccntgggag

SEQ ID NO: 995 - DNA, 378 bp, Homo sapiens
  Genbank Accession No. W20486
  unsure (1)..(378): n = a or c or g or t
tcaagcaaacggatgattttaatgaggggtgagaagcactccgcagtgcggcaagcggcgggctnggntcggggcccagcaccggtgggagcggggcttctctggcctcgcgcgcgggggacgngccctttcccctccggggaacgcgcaggaggcaccgcggccccngggttggaacaaacgcgtttactgcaggcaaggcggcgggcncggggcggcttcaccaggcgaagaggggcttgcgtcctccttggagaagctccgcacaggcagttgaagcagcagcagcaagtcgcccaggaacttggggggcaccacgtcgatgaccagcttgcgcacgcggcccgggcttgctgtgcaagggggttggcgcgcagg

SEQ ID NO: 996 - DNA, 687 bp, Homo sapiens
  Genbank Accession No. W28214
  unsure (1)..(687): n = a or c or g or t
ttttcangagctggccctttcaactcagtttaggggcgcagccagctcncttcccaatagggctctttctgctttccctctccttggccctagatttgtaatccatgaaaaagcacaaggtcctggctccttgcggtcacattctggttctctgtgtttggtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagnactctgtactgtcccaaatagnaaacaantcacttngtggccagatttctgaatggaaatgagaaattgaattcagcttgggacttaaccaggctgactngntaggggggnnnnncannnnnnnnntngntcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 997 - DNA, 870 bp, Homo sapiens
  Genbank Accession No. W28548
  unsure (1)..(870): n = a or c or g or t
tctcacacattcacgcatccagtcatccactcagaggccaaccagtcacacattcactcactcacaaaaacacaggttgggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattggggagtttcttatattttcatgaaatatcctatttngggctcctngtgttggtggaacttgagtgattctgnagggcaggagcctccagtgangagttggnagggatcttggaaaactggntttnattttatttgggtgggtcggaattcagttgggcttaaccaggntgacttgcaaaggggggnnnnncnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccc

SEQ ID NO: 998 - DNA, 296 bp, Homo sapiens
  Genbank Accession No. W31470
  unsure (1)..(296): n = a or c or g or t
cgggcgcagagggcgtttattnggacctgtccttcccagccgctgcttgtccaggttcagcgctctccgcgggtgaggcaaggaanncgnngagacgcncgagccggtcaccacaaggtccgcctggaccccggccgtcacggacgtacctactggatgcagatggtccagggatctgggggtcctgggagagtggtgtgtggactgcgggcccagctggacaaaggcaggggcttcctcagaagctctgctggtcacgcaggcgtccggcccacggctttcaacagccctgcaag

SEQ ID NO: 999 - DNA, 353 bp, Homo sapiens
  Genbank Accession No. W33172
  unsure (1)..(353): n = a or c or g or t
tttttttagattggtagaggtggtttatgtgccccatagccaagagaggtgtgcaccaaggaggatatcatcaaatctgacaatctggaaagcctttgaaactgttcttttcctaagcacagtattcagctgtgtcctcttgaacccatatctatcaggtcaacagctttagcccattccacatgatattggctgtgggtttgtcatatatagctcttattattttgagaaaccgttctatcaatacctagtttattgagagtttttaagcatgaaagggccttttgaaatttttggtcgnacgggccttttcctggcaatcctatttgagnataaatccaagccgggttttt

SEQ ID NO: 1000 - DNA, 437 bp, Homo sapiens
  Genbank Accession No. W33179
ttttttttttattttcataacttgcttctgttgattttttttttttgtaaaactttcccaagacattttcagacttaaaaataaagtcagtgttacaggtgctggtcagccttcttacttgtacctcaaacactgggataaaggaggcggtccagggcaatgcagtgatgtctgtcaagacattccccctcccctaaactcagtagcagttgaggatgacatttcaggctagagagacccaaaatacctctgttccacctgagagcaaggtggaagttgcatcagctactgccccaagtgagcttcatcttctgattgtgggctttggaggaacgagagaactggctcttgggcactgtggaggggtacagctttgccactcaaatataccttattgtgggcattcagggagccagggtccagagctgcagggctgc

SEQ ID NO: 1001 - DNA, 506 bp, Homo sapiens
  Genbank Accession No. W37384
  unsure (1)..(506): n = a or c or g or t
ttttttttacacctttctattttttattttttacatcaaacaggtaatgtgatgatgctgtaacaaggtttgagggaagcatatctgacacatgagcatgaaaccaaatcaccatgcttatggactacaaaaggacctaagccttttaaactagactgtctcaactgtgcattaattatgtatttagatataggatatgtgcttgggaaaatgtataactaaactttatgtcttacttctcaaacttaagaaaaacaaaaacatctagcaacatcttacatgagttttccattacctagtgttacatcattgttaaaatcatactctaagcctatattttaccttaatgntatccggttcctagaatagttattccnttaacacttatttttaaggaataaatttaatttacntggaggtacctaaaccccaggaaataattttttccaacggtaggaggtacagccctttataataggntaggtccnggattgggtccctcgggg

SEQ ID NO: 1002 - DNA, 383 bp, Homo sapiens
  Genbank Accession No. W37778
  unsure (1)..(383): n = a or c or g or t
agaggttttttattcggccgggagcatcagcagactcgcatcttaagagccgagctccccgaaaaagaaattcctagccctttgaaggnttgacaactctaaggggtctacgtgaaagagtcataatagatcaagtaagtgtgaggaatgtgactgtgggctacctacatcagctaacagtacaaaaagttttacagtgctttctcacacaatgtctggaatttacagataacaccagtangttttggtcaggggttaatattattatcattctaaccaccagggccaggtggtggcgccaaggtcgtctagctatttatctttcttctgtttctttccaactttttgctttctcccttttctcctgtcttataaactaggga

SEQ ID NO: 1003 - DNA, 374 bp, Homo sapiens
  Genbank Accession No. W42483
agcacaacactcatcttttatttatttattatttttttttactaaggcacatgacgtagaaatattgaggtacaaaatgcaaatttctgcataagatttttaagatattcattttggaaaatgaaggtgaacatcatctcccagaatattcagcttttagcttgttttttcttttggaccagttcaaccagcaacttgtacctagcgatacagtcttccttgctcttggacgggacacatctggctattttgtcccagcggtcagaggatccccttgggtactgctgcaacgccagttccagaagtttctgttgattttgagtccacggctcctctgcagaccgagctctctcttttctcaggctctcctcgtc

SEQ ID NO: 1004 - DNA, 383 bp, Homo sapiens
  Genbank Accession No. W42778
gaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactcgatcgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaa

SEQ ID NO: 1005 - DNA, 377 bp, Homo sapiens
  Genbank Accession No. W44558
  unsure (1)..(377): n = a or c or g or t
tttttccagaaatgcttttccttttatttcagaagaaaggacataaaggcagacacttccccctcccctnctgncannncnnngaggtntnggttnacccagaactggagtnaaaggccagggcaggaccagggtccataaagcttgcccttcccccaacccttccttccctcaaagtggcaaggttagaaaaaaattaactatgttgttcctccctggcactggataaaggccccactgcagccaaggagaaagaggggggtccaggctcccctcccanggcagagaagctgctggctnggctacnggggagggtggaggtggaggtaggttatgggacagagaggacaagaagtgccctgaacaccttttccctt

SEQ ID NO: 1006 - DNA, 476 bp, Homo sapiens
  Genbank Accession No. W44760
ttttttctggtaacagcatgtttaatttattattattgcaaaagaacagtttttctcatgattagtgaaatagaaaactcacaatatacttaagagtctgcccccaaaccattacaaaggggttgagagaagagagaagcagaaaccaaaagagaaacagaagtaataatcagttatcacatgatttttatagtaaacaatagaatatgatgtgcaatagtgcaattttcctttgctagtccagcaatgcaagtaagtcttaataggaagtccactgtgttactttttgtatttcgggatttagttgcgtgcttgccgggggttcgagttcctgccagacttctgactctgagtggaatcactattgctagaatcacttttactgagtccaagatgacgaagcttcatatcccagcgcttaacttttttaccgagtcgatccttccacttctcagctatagagccttccaccaaga

SEQ ID NO: 1007 - DNA, 402 bp, Homo sapiens
  Genbank Accession No. W45531
tttttttttttttgaaatttgataaatgtttattgacttgctgattcaaaaaaacagtgtagctgagaagtctgatcagctcagaaaagagtggaatttggcaacaaatatgttatccaacaaaatctgagtaatttatcaccttttaacatcttcaacatatttataatataaatattttttaaaaaaccgattattaaactaatactcccctggaagaacaagaggactaattttcggtgacgacagacttgtgctgatccatcatctggaactcctaaagacctgaatggctgactgggattagtgactactatctggttttactggttttactctactaagcccatgattttgtggttttaaccaattaagaaaattatccccaagcacaataaaaat

SEQ ID NO: 1008 - DNA, 534 bp, Homo sapiens
  Genbank Accession No. W45664
  unsure (1)..(534): n = a or c or g or t
ttttttcctaaagtcatttattttcttcgagaactctggacattccataactgggtgtgtagtatgagtagaatgaattcagtgctagcctcttgctggagagggacaagtgcaggtttagaattacagcttatgttagaaggttctcttctcatcgataccttcatgttagaagaaagaggacagaggcagagctgatggaatctcataaaataacagctaatgccgtgtgtcaggcactatgcttaacaagtatctgtttaacatgtgtaaatgctctttagctcttgcttttctataatataaaacagtcctgggagtcctgttcttccccttcctttctctcgtgtcctttggactgtcttttngcagcctctggcctttctcattatctactacagcttgctacctgactcatcaaaggcacatgggtgttgcaagagaggatgggaacccggtggtttataccattaaactggccattataacagggagctataaggtggaaaaataggagnccaggaaataaagccg

SEQ ID NO: 1009 - DNA, 444 bp, Homo sapiens
  Genbank Accession No. W46395
  unsure (1)..(444): n = a or c or g or t
ttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttgggaggagtcagtgcctcactccagcagtgagtgcctactgtatgcaggtagtcagccaggcaaagagagactaacggtctcatgggggaacctcttgan

SEQ ID NO: 1010 - DNA, 489 bp, Homo sapiens
  Genbank Accession No. W49708
ttttttcaccgcagagatgtttttattgaaatgcatgttatgagtaacacatgaactccctctggcccaggtgggacttcttccctcataggtgggtcaggcccagtgggacagtcttggtggtggtaagaagggagccaagtgacagaaggtctccaaggcataggagatggtgtccggtgagtctggggaaccgaggattatgaagcctgctggaagccttggtatggtatggttcttctcagctgtggctgcagatttctcttcattggctgcctcctctgaaaacagactcctcttttctgcaattaatcttttaactcctaccatccactgacttgacctcagtcacatggtcaaccatgagggagcggtggatgtcatctgctgcgtcccaccggtggcttgaaaagctcttgcaccagtagagccattctcttctttacagggtattgacaactttcctccaagcccactgttccttgcaag

SEQ ID NO: 1011 - DNA, 678 bp, Homo sapiens
  Genbank Accession No. W51743
  unsure (1)..(678): n = a or c or g or t
cacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggtctgtgccgcacacgcaaaatttagaatctccagctagctctatcgtgtgaggnccagattagggaantgccatattacc

SEQ ID NO: 1012 - DNA, 453 bp, Homo sapiens
  Genbank Accession No. W52065
  unsure (1)..(453): n = a or c or g or t
ttttttttttttttttcagaggtcaaatcacttttattctttaaggattcagtgtaacatccttttctttaataaaataattaaacactggcagaaattaacttattcaaaaagtcatactaatactttgttatgactttttatagaaaaacaaactttatttttttatttttttgagatggagtcttgctctgtcacctaggctggagcgcaatggcacgatctcagctcactgtagcctccacctcccaggttcaagcgattcccctgccttagcctcccgagtagctggaattacaggtgtgcgctaccatgcctgggctaatttttgtatttttagtagagatggggtttcaccatgttgggaaggctggtttcgaactcctgacctcaggtggattcacccgccttggcctcccaaagtggctgggattataggcgtgacagcctgna

SEQ ID NO: 1013 - DNA, 618 bp, Homo sapiens
  Genbank Accession No. W52493
  unsure (1)..(618): n = a or c or g or t
acttcgggaacagcgctgtacatacaanattacaatanactgattagctgtagactaataaaacatttaagacttcacacacacacacacacacacacacacacacacacacacacacacacacacacacacacacaatgattggagggctatatgatccagcattagcttcctggtgtgccaagcatgcttgatccgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggtttgaaaaaaaaaaacagtttcagaaacctgaatccagggccttatagttctcctcattatctatcttcttctcccttccctcgcccaaggggagtggggggaaacacttttcactgcagagtttgctttaaagtttttcccancttgcgtgcattatcccntgatattaaaattaatttctcagtttaatccacncctgctgagaaantggtgtgagattaggcngtgggggtttttt

SEQ ID NO: 1014 - DNA, 466 bp, Homo sapiens
  Genbank Accession No. W52638
  unsure (1)..(466): n = a or c or g or t
ctcagtttgggaccaaactgcttggatctttgtaaaaacccggttttgtatgtcaaggaggagtttaaggcctttccgaccaccttgtgttccccttttctgcgcaccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttcntttttttttttcnttgtccttttaacg

SEQ ID NO: 1015 - DNA, 511 bp, Homo sapiens
  Genbank Accession No. W52858
cacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaacccgaaatttgttttatgcatgagttaataccactggctcagcaaatacaagttagtttgctttaagcaggtaactttttttgtaatggaacgaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatggtaaacattggtcaagctgtgaaagaaaatgggctggaggtgtgctttggtgtggaaagggtgagcaataaaggtatccggttaagttccccaaaaaaaa

SEQ ID NO: 1016 - DNA, 426 bp, Homo sapiens
  Genbank Accession No. W56792
catcattttttattgtaagaaaatacacagtttgaaagtgtgaataatgcaatatttatgaccaagaaatgggacttaggaaggggaaggaagataaagaaaaagatcaagatgatctgattgagagacagtgttgaactccaaatactgaactggaaaaggagggaggtggggaggaacaggaggaggaagtaaaaaaatttgatcagagaaacagttaaaatacaatatgaaaataagtaatacctctccttaaattccttctatacacaaaatacacgatttgccaaagcccaatttgtgctactgggattctgtgagctccttaagtgtattcacatcctctgcaacagcagaaaatgattatgatacaatcagaatatgctgaagacaagttaaactcttgccagcaggttccttaaaaat

SEQ ID NO: 1017 - DNA, 426 bp, Homo sapiens
  Genbank Accession No. W57931
  unsure (1)..(426): n = a or c or g or t
tttttttttttttttgggaggcaggagttgctttttattgacttggaagtgggctcttcagtgaagcccctttggttntaagagcattttcctgcttcctttgttcttcctgcaacttctgctgcctgagctgccatgcttgtaatccagcgtccatttcctgtgacagcagtacaactcgtcttgcaaacgtctccctttcagcttttcttcgaagctggcctttcattgggggagcagggcggccatccgattatgaccagtctgggagctcggtaaggggcccgtaagccggangggttggcagccaagtccctgctgtantcgccactggccgcccgcccaagcggttacnttgcagtgcacccttccggacacctgtgaagagaacagtccctaaagcagccatgtgagcagcctcgtgcc

SEQ ID NO: 1018 - DNA, 98 bp, Homo sapiens
  Genbank Accession No. W60186
aacttacaaacaaaaataccgtaataataaacccaaacaaagaccctcagcttgctgccacgttctctatgcggtttggcggggcgggtatttacaag

SEQ ID NO: 1019 - DNA, 551 bp, Homo sapiens
  Genbank Accession No. W60649
  unsure (1)..(551): n = a or c or g or t
tggggcccaatggcgatgttaataaatacataaaattttaaagatctggatttccaaggcacaagagtttaacacaggccaggctggttctcacaggaatgactccacgtgtgccccagcatcccagggaggggagggcaacagggggagggcggggagccccanggacctccactctccaaaggggttgcaggccagggccnactactcatgttcctccaggctggctcagaacagcccctttgccttggggaaggaagaagtgagaagcacctctatcacctggcaggagtttaggagacatcctccaagaccccggaggtgtcctgggaccccctgccacttcctgagagccagaggatcttaagactnttacctgtccctttggaggtagcatggccggcagctgagcacagctcaggccctttacagcaccgtggggtgaagtgtgtcttccccactccagcaccaagccaagggnttggcaccctgccctggggnaatttggcctnggtggcccttgtcatttccaaggccaagctatgaatgga

SEQ ID NO: 1020 - DNA, 597 bp, Homo sapiens
  Genbank Accession No. W63793
  unsure (1)..(597): n = a or c or g or t
ggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataaccaaaaccacggatgatagaagagggaaagtttggggccataatttctccttcactggtgttgacctaaaccgttggaaaggaattccggncccaatt

SEQ ID NO: 1021 - DNA, 447 bp, Homo sapiens
  Genbank Accession No. W67225
ttttgtgttccaataaaattttattaacaaaatatgacagtgggggggccacagtttgccaaactttgccttggaggacatgcagaggcaccctcagaattcagtgaaaacctgctcccatattgctaagactcatgaagtataatctctcatcttctttctctttcccctgcccaagccctaagttagggttcccatccatataacaaagacttctggtcaggtggcatttgctatctctgagattccctgcccatgaaagccacaaagagatttcttcttttacacaccctgaagcatattatggccccagcaaggctaactaaatcaaactgtggtttaaaaacaaaacaaaccaaccactgtgaaatatttatttttgttttgtagtattaagcatgattaaaccagtgcagaaaaatactaagtacattgggtaaaagatga

SEQ ID NO: 1022 - DNA, 411 bp, Homo sapiens
  Genbank Accession No. W67577
  unsure (1)..(411): n = a or c or g or t
ctaattactaccttttattctaatgtgaaccatgggccctggaaagctgataacaagcttggctgagcagagggaactaggggtcaggcagaaaggattatgggntggaaaacattggctcttccttgggnagtggatgctngggaaaggggaagagagtggctcancctggcaggtaaataggctagaaaagccaaggccaaanctggngaggggagaggacagtcagcatgtccagcctggggtctgggtgtaagggttatcccttctccctggtgccttcccatctcgtccatgagcctaaggtcttgggagccttgtgttgggaggctgctgtgatgtcagggaacggggatctgtctagcttttggccacttcctggggacctcacacccctgtttganaaattgg

SEQ ID NO: 1023 - DNA, 473 bp, Homo sapiens
  Genbank Accession No. W69302
gctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaagccacgtttcatctttcctggatcactacagtgaagtattacacgttgtacacgttcccagtctggccttggcttgctcggataaaactttgtatgtattttgtatggcatagattctatattgtaatgatgtcctatgcaaaaagagaaattaacgaaattgtaaattttattgttttaacgtgtatgcatgtttagtgacgtttacattttgaaataaaattt

SEQ ID NO: 1024 - DNA, 128 bp, Homo sapiens
  Genbank Accession No. W70131
gttttttgacttcatttattatataaggaacctaactcaaattggcttaagcaattaataaatgtttattgttacattgttgtaatgtggctggaaatccagaagtcatacaaatctgtcaggattgg

SEQ ID NO: 1025 - DNA, 428 bp, Homo sapiens
  Genbank Accession No. W70167
  unsure (1)..(428): n = a or c or g or t
cagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtcggacgtgctgttcggagacgggcatcgctcgattatgcgcggcgtcatctcaccgctctggaaatgctcaccgccttcgcctcccacatccgggccagggacgcggcgggcagcggggacaagccgggcgctgatactggtcgctgacagcgccaaagagaccaacaagatgattttagcgtggactaggacacttaacctaagaagagtttcacttaatcattcaaatcactatctgaagggtcacggagcgcaaaataaagtttaaaaccctgctaccaaaaaaaaan

SEQ ID NO: 1026 - DNA, 359 bp, Homo sapiens
  Genbank Accession No. W73038
ttttttttttttttttaaaaatcagatggggactttattgtgatggtggcaggtccaccagcagatgcaaatgtggggtgctgagagtggcaacacaggccaccccaaaccaacttcactccctcccctgtcctcagccagtacagaagccaaatgtagccccagccctagactccagcccaggcagagtccaagggaggggtgtcagggtcagaagtcacagggagcccagtgactatcaaggtggctgagagcaaggctagggtagggatggggcagagaaagggcagggggtgcagcccaggtggcccaaagcaacacagaggagcaagggctggcattcaagtcagcaggtccct

SEQ ID NO: 1027 - DNA, 620 bp, Homo sapiens
  Genbank Accession No. W73790
  unsure (1)..(620): n = a or c or g or t
ctggttgacaaagagggtatttattgagggtttactgggtacanggagaagggctggatggcttgggatgcagagagagacccttcccctgggatcctgcagctccaggcccctttgggtggggtcggggctgggaacctatgaacattctgcaggggccaccgtcttctccacggtgctcccttcgtgcatgacctggcagctgtagcttctgcgggacctccactgctcgggcgtcaggctcaggtagctgctggccgcgtacttgttgttgctctgtttggagggcgtggtcatctccacgccctgggtgatgggggtaccatctgccttccaggtcaccgtcaagattcccggataaaagtcattcatgagacacaccagtgtagccttgttggcttggagctcctcagaggacggcgggaacagagtgaccgagggggtggccttggntgacttaaaacggtgagctgggtcccgctgccaaacacatgcgtcactgagttatgcttggattgaaaccccggggccancacttggggcagtccaggagccgccttgaacaggaacctgcccaccggttcctaagcttgaccgctgnttctccagggtccaggncc

SEQ ID NO: 1028 - DNA, 697 bp, Homo sapiens
  Genbank Accession No. W73859
  unsure (1)..(697): n = a or c or g or t
tggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggangcgcncnctgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttccaacaagtttgcacttttgaaataaaccttctttatatgctaaaaaaaaaaaaaagatnggcggantttccttggggggtaattanttgatgcgcgttaangcgg

SEQ ID NO: 1029 - DNA, 676 bp, Homo sapiens
  Genbank Accession No. W74533
  unsure (1)..(676): n = a or c or g or t
tttttcagttggacacaaatgtatttattttaccctagcaatagaacaaaatataatttctttagccatttttcatgagaatagttcattgtacagttgaggaaacatatgaaataaggcctgtggttgattgctagtggttaagcatgttttcaatctttgccttaatgtaaaagatttgcagtgaactgcaaactgatgcagaatatctctcctgcttttccaagtcttgtcaggaatagtaaggtacagtaaatttgtcccacaggattttaaagcctacgtcttgtatataatacaatgcaggcctacaaaaatggtgcagccatatttacaaatttagttcacagactgctgcagtaaaatggctggaaagttttgttttgcttgtttcacaatttctctaaacagcagcagaatcttaaaatacctggctggcatctcttttctttgtaacaaataattcactttagtatactctgtgtatatacaaagtttttgtatgttttataaaaattcacagaactgcaaggttcagtcacttttttacaccagagaaccacaggtcaagagcactcttcaagcagagttgagggactgcgnagccaatggtgccttattattaaacccgcatgggcctggatcctagctgagataagntgtaccacgcatgcct

SEQ ID NO: 1030 - DNA, 496 bp, Homo sapiens
  Genbank Accession No. W76181
  unsure (1)..(487): n = a or c or g or t
cgaggagtcggggcaaagctgggcctgcgtgagattcgcatccacttatgtcagcgctcgcccggcagccaggggtcagggacttcattgagaaacgctacgtggagctgaagaaggcgaatcccgacctacccatcctaatccgcgaatnctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctggtctcaaaa

SEQ ID NO: 1031 - DNA, 315 bp, Homo sapiens
  Genbank Accession No. W78127
gaaaagacgtgcttgtcattcttaataaacaactagagtaagaatacataagagaaacagagtggtatctttatatgatacacaagtgtatgttacaagaattccatcaggcacaggagcctcaggttttaaggcctcaatgttaggccaacaaaaaaaaaaaaggcatggtaaagtttttacttttacatctaaaatgtcacttgtcataaaggagggtgtaatagaaattgtctttaataaatcataattgaagttcccctcatttttcttccattaagatgctaagtttatgtctgatcatgaagaaagaaa

SEQ ID NO: 1032 - DNA, 556 bp, Homo sapiens
  Genbank Accession No. W80509
  unsure (1)..(556): n = a or c or g or t
ttttcacatcgtacatgtttatatctagaaaacgccaagtcaagtaatcagtacgtgaagcgggccgagtacccgatggcctggcccggggtgaaggctgtttagtgaccatggaagtgtgtgagatttcacgcacacgcattcatgtcaacaaggacatcaggagaagttaacattatactgaagtcttaagttaaaacatttctgaagtgtatggaaaggtttcactagctgttacttttctaaagtcccttgccctgtgttactttacccagacgcctctgctctttatcgtggatcaaagtccctggggcttttgtgtgtccccgtcaggcggcgtcgttggcctcagcaagtgccttggtgggcgaatgtgacgttccccccagctgggtcccggactggacagtgtgggtggttggtgccatcgcactcagcagacaaggtgagtgaccccagcccagccctcccttgtcccggtgccatccgggaaggtgctggggaacctgtcctttcccctntggcccggggtggcacctggnaaagcaagcccttg

SEQ ID NO: 1033 - DNA, 418 bp, Homo sapiens
  Genbank Accession No. W86513
  unsure (1)..(418): n = a or c or g or t
ccagtgaaactcattttattttcagctgaaaaatatacacagataagcattaaaattgaattattataggttttctgaaaataaaattttacaatacttatgtttaacaaagattaaaaaattcaaacaaatcaggaaggcacaggtcttgtaaaatgtaataaagaatttagtccataccttgatgcatagtggtggcattaaatggcacaatttttcggtatcatgcctgcctgccttagatctcaaacagacctactctcttttccttctttctcatcttaacaaacttttgataatcaagcatcatagtatgacaaagagagtaacaagagctgtgcaggccagcacatccagagagcagtactgaaaccaggtgagcttgtgggcaggtngcagcaggtacttgggctccatt

SEQ ID NO: 1034 - DNA, 411 bp, Homo sapiens
  Genbank Accession No. W86660
  unsure (1)..(411): n = a or c or g or t
antcacctctgtcccccaggctggagcaaaataaataaataaaggtgcagctgtgggtcgaaggatggtgtggaagtttggggtagacatccaagactgcagtaatgctatgcccagggtatattttggggcaaaacccccaaaataccctggcaaagaaagaagattgtgtttcagttgcaatcatctaccctaatccctttctgagggcctctggactcgcttgggctcactgcccttgtctgatggggtaggatctcccagaggagaccagctaattatactttaatgaggtgacttacagacactggaaaaggagttggctggtacactccccatcatcatnagcagctctctncgaggatacagtctgtgaataaatggtaccagaacnctcttgagcctcgtgcc

SEQ ID NO: 1035 - DNA, 265 bp, Homo sapiens
  Genbank Accession No. W88568
gttttttaacattttaatttcaacgtgccagcatttgtccaaatgagatgatacaggctagaatgcacggcggaattccagactggactcactccataagccaactcatcactgcccgtgaacatgaattctggtcctcagagaagctgacattgtttccctgaacattcccgtggtctccctctgaaagccgatgaccatccaaccctgactcacctgaaatatcctacgagcatcgccctccgagactgacgattattaacca

SEQ ID NO: 1036 - DNA, 395 bp, Homo sapiens
  Genbank Accession No. W92207
  unsure (1)..(395): n = a or c or g or t
gtgttccaataaaactttatttacacacattgaaacctgaatttcatacaattttcacgttaccaaattttaattttttttcaactatttaaaaatgttaaaaccattcttagctcacaggctatgcgaaanagancaaccagccagattcggcccacggtttaaggccagtttaagcctcaccaccttcctagccccactcacctattttgtcctctcatcttcctgtccttcagcacccccatgaccttcctgtgaccttcaatggcccctccagctgccgtccagccctgtctgtctgcccttnggggaccctctcctcctgggctgcaggactgttttttcctggagcaggtctctaaatagctccattcgccttggcagggggaatccag

SEQ ID NO: 1037 - DNA, 241 bp, Homo sapiens
  Genbank Accession No. W92449
ttttttagattcatctttttaatgacatcctaaaattcagaggaggggccagcgggacctctgggctcagcggctgtgaaggagggacccgcaacacccgctaaggcaggtaattgcaagaaggcactcgcgagggggacttcaagcccctcttctatttcttcatataaaatcagggggatggggaaagctccaagggcgagggaagcagagagtttctctcccagcctatggaataagg

SEQ ID NO: 1038 - DNA, 571 bp, Homo sapiens
  Genbank Accession No. W93396
  unsure (1)..(571): n = a or c or g or t
tcacatatttttgcaagccgtttattaggataccgcttaaataattacttcttgtttttatttggcttttcttaaacatggtcttgttaggtgaggtttcataaccaccacacaactgtctttgttctcacgctgctggagcgtgttttatgggcattgtgataatagctgtagtttccaacggttgcagtagctgactagtcagtggcttcagcaacacacatttattctcctataagccctggaggtcagaagctccgatccaggtgttggctgggttccactcctcctggaggcgctaggggaggatctgtgtccctcttaccatttctaggatccgctgcaccccttggctcaggcctctcttccatcttcaaagtcagcagcctctcctcccctctgaccttggcttcctctgcccgactctgaccccttggccttcctcttacaaggancctgtgatganctggcgcccanccagctaatccaggggaggagaagagaatactgagcgtcaantcgttgtaagcttttcagaattccttgggtttttggtcctttaaaacggggt

SEQ ID NO: 1039 - DNA, 355 bp, Homo sapiens
  Genbank Accession No. W94333
tgaacatttcatcttttactttttagcaccaacagacttgataacagcctgatgctgatctgacaatgggttgatagccttcccccactgacccttaaatctgcttagtaacaagtcctttgcttctgtcattctcctgggggatggcctactcgccctcctttctgtacaatctgggcaaaccgactggtgatggcaagagtggtgtcaatgaagcggtctacacagctggagagacaattttcagtgcgagagtctaggcgattccctggcttctccacacatttatcccaacataactccatgaagtgatgcacctgtgcagtaaactgcgccttctgctgctcggcggcca

SEQ ID NO: 1040 - DNA, 1761 bp, Homo sapiens
  Genbank Accession No. X00351
ttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 1041 - DNA, 3768 bp, Homo sapiens
  Genbank Accession No. X00371
cctctgacccttttggtcgctaggagtcagccgactcagtacacaggactcactgaatggagacacaaggctcctccagggagtggcggctcatggcaatcctagaatggtcaccagccaggctttagagacccacacagagggcgttctgacccaaagttgcactggggaactccaagtttggggattctttgaatttaactctttttctagctacatttcctattatttgtccaattcttaccaaacatctctgttcacattctgaagctgggatctgactggcagagctagtagatgctgactattcagatggagccctgacattggctttctcagcttggctgtgactggcagcaggtttgcgggagaactgtgtgtcccagaacatgactggctacacctgcacctcagcaagattggggcagggcagttatcttcaaaaagctgtgtaggtggggcagtcattactgacaaatccagtgcagacccaggatggcccaaacactggcttatcctttctgaatctcatctcccacagctgtaaagcggggtggtgctcgctacctcacagaggtgttgtaaagattagatgtaatcttgccaagcagccactttgtaaactgtatagtcttatgcagatggaaggaagggcctgtgcctaccttgatcatagcactaaacaaactgtactgtattttcattcctcttagttatctccctaaaaagactctgagttccttgaacacaggaaggtgttttatttgattttgttatcctcagcatgtagcagtgtctgacacacagtaggtgctctatcactgtgagagggatggatggatgggtggagttacagatggatagaaggatagatggagggatgggtggatgatggatggatagatggatggaggggggatgatgaatggagggataatgagtggatgaatgagggaatgggtggatggatggatggagggatggaggaacagatagatagatggagggatgggtgggtgatggatggatagatggatggagggagggatgatgaatggagggataatgaatggatgaatgaggggatgggtggatggatgaatggagggatgatgggtggatgaatgaattgagggatggatggatgaacacatggatggatggatagatggatagatggaggaactggtggattttggatggatgggtggatggatagatgaatgaatgcctggatagacaaagagatgatggatagatgaatagatgaattaagggatgtcggatagatggagggattgatagatgttggatggatgggtggtggatggatagatgagtgaatgcatggatagacaaagagatgatggatggatgaattaagggatgacagatggatggatggatgagtaactggatggacaagtggataaatggatagatggttgaatacctgaatggattgaaggaggatgcatggatgtaagataaggctaatcatcctccactctctttctttgcaaaaccatccacccatttactcaataaacatttattcagttcaaacttggcacaaagcaccatgtgaggcccaagagatacgtgggttaataaaacagagctcctgccctcctgaaaactgcaaagaaaggggcgtggcttcctgagttcaaatcccaactctgccagcgactagctgtacatcagtgatgtttccctactttctctcaattaaatagggataatgtcagtacctatcacattgggaggtcttgcggggattaaatgagttaccaaatgccaagtgtttgggacagggcctggcacccagcaaagtctcttgtgagtgctggctgctattatcctaatggagaagatggcatgaaaaccaggaaataggatgccctttgggaagcaatgcaacaggaacttacacaaagaaaggaaaggaggaagcaattagtggtgtctcaaaggagtatgtcaagaaaaacttttcagagggaaacctttgagcagggccatgaaaacaggagttctctaagagattgtggacttgcctgggaccacctggctataagcacaaaaccatccggttcctttctgtcacttctggcgggtgaggggtctctggcaaaggggcagaaggtgcgtgagaggttgcgaatggcaggactgtcctggccagccggggcacctggtggccaagcttagaaacatgacaggtcctcttgggagggctgaccgcagggagcgttgggtttcaggctgctggcgtcggcttctgtggtgccctttctgtcggctatgagagtccagacagtgcccaacctcctccccttctttccacacgcacaaccaccccaccccctgtggcctgagctgtcctgcctcgccacaatggcacctgccctaaaatagcttcccatgtgagggctagagaaaggaaaagattagaccctccctggatgagagagagaaagtgaaggagggcaggggagggggacagcgagccattgagcgatctttgtcaagcatcccagaaggtataaaaacgcccttgggaccaggcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcaggtaaaaggaagagattccattgcccctgccacccacaccctaagatcaagggtgttcagctgcaaggtggaaagtttgcacgtggggtaggtcagttggctgcattagttaagggtgttagaacggtcacttgctttttctttgcttttaagtgtcagggattggactcaggagagggaaaggagccatttcaggctgatatcagcagctggaggaagcatgagaatcaaacctaggatgctcagagtccaccaggaagaattttagaattatagacagtcagagttaacaagggtcctgagagattttgtacagccacctctcttacaggatgaggacaaaaagcgactgagaaggggaggacatttccagagtcacagctcattaaatgctcttaaagtgtcaaggttaagacatgctcttcaaggggagacagatctggttctagacttggctctgccactgagccactgggtgacctttgggaaggtactcaacctctcggagcctcaatttcctctcctgtacagtgaggggatatcctaatatctatatcctagaggagatgtgagaattaaataaaataatgcatgcaagaggcctggcatggttcctggcatatactgagtcctagaaatgttagtagctattactgatgaagcccaggctagggacctttcaaagcattgcaattagagaacagaagatagaggctcattagtgaccttcgatgttgagtatgtctctagtttgagaggtctgaatgatgtggtctgcaagtatatcctgccttctaccacaagggattccagaatacaccaaagaaaacaaaattctgaggtttgtaaatagagggtggctgtggtttgtacatagaagctcatctcctcgttgccttctatcccaaaggtgatacactcttctcttggccccttccctcaccattctgagctggttccctcagaagtctaataggttaagaatcaacgtttctgccaacgggaggaaggaagtgggcgccgg

SEQ ID NO: 1042 - DNA, 803 bp, Homo sapiens
  Genbank Accession No. X02544
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttggggccatcctgcccctccaacccgacatgtgtacctcagctttttccctcacttgcatcaataaagcttctgtgtttggaacagct

SEQ ID NO: 1043 - DNA, 14646 bp, Homo sapiens
  Genbank Accession No. X03100
  unsure (1)..(14646): n = a or c or g or t
tttgatcccttaaagataacgtcccctaggaattgttccctgagccagaccctccaagaatggcagttcggctcttacctggagtggccctgccctggaccacagatgtgagcagcaccatcagtaacgccgtcagagccactgtccggggggccgcagaaacctgcagaaccatcatggagctggaaaaggatggcaaaatgaaaagagctgcagtcaggaaaagaaggactcgctaaagggagctcctgtttgaaatattagagaccatgaacccaagtagtcttctgtgaccctgggattggacagagtctgagaaaagaaccaatggacactgagctttgtatgagtcattgctcactaggcagaaagttagtatgaaaggtctgaaaatataaagcctgtgatgcacttaagatgacggaggaaagacagtgatactcattttaaccagtcagataagtcatgatgtttggggagattatgcgttttctttgctctgaaggtgatctcaaatattctgctggcccatctacagggattatcatttccccaattctgccacacctcacacacccacaggacatggtctgttgtggaaaaagtgctatcttagtgtgtaaaaggtcattcagtggcatgacttagagggattagagtacccatctcagaactcaaatgaggtctgagtctgtctgtcttgcctttgtccaagggtgtgtttaagattagcacccattcatatttactttctcccagaggtctgtgagtcctgcgatgtgcaggagttaccaggttcttccacaggactgtcatcagggtcaggagggctcagtctagggaccttacactgggagcgtggacacaccacctaccctaccatgtaaatatgcagctttaacgacactgcctctcttggacttcgattccttgtcttcaatatggggatgatataacctgccttatagcaaagctcttaagatcaaatgagatcaataggtctgaaattgctttggaaaaataaagtccatagagaatataaattgactggtaaataaggaagaaagtgaaaaaaaatcatcaaagaccccacctccttcaaagcatctgattctattttgtttagagtgaatatttttacaaactttcaaagaacattacttcttactttagacacttataaatgtgatcctgttggaccaccaattctaatttcaaaaaaaatcaaattggcatcatttctttaaatcaatattaaaatgtaaatagaaggctagcatgtaaaatgcaagagaagaaaataattatgtagtagaaggtgtctagtaggattaaggggccaggagaggattgtggagaaaaactcagtttttttagtaactgcctgggtgggacttttctccttgtcatttacctgccatagataattagacaaatacttcctcgatgtctcaggtaatttatttttacagtagacattaataatacctccctcaggtttaatatgaggtttaaatgaggtaatgcatgcaaagcactaataacagaatctctcatgtcctaatctgttagtaattattatttatgcaaggtaaggctaccacaaataagataaaatattaacgtaatatatgtacttcatcattacattaaatagtaaatgttttgtgaccttctctatgagtatcaaataaatagctcaaaattgaaatatttaaaatgagactagaaaagtatttcttaaatatggtaaagagaatataaaataaaaaattaacattacctgtaacagaaaaacattagagaaacccttcttaaaaacaagatcaaaatatgggcgcacattgttaccacaggtaatgctgtcctgggtattcttatatgaaaatgaaataacaagactagtaatttaaagataaaaatgttattacactgtttaaataccaggaaaaatcaaatactaagaaatctgaaaaataaaaattatctagaaatttcactaacaaaggtaaccaggaatagataaacaattaaagatcaacttcattcaagttaattaaaacctctaaatagaaattataacacttctgcagaaatgattaaataaaaaggaggtatctcagggaggtggacctgaaagaaagattaattatatattttattagatagcacattcattcttaattatcagcagaatatttttgtaaaatattgacaacataacataaaacatgatttaaaatatagtgaccaaaaaacatcaaagatcatctgactgtctgggatgggggtggggctcgggagaaggaacataatggaaaacatttgccgtcagaagaaggtgtaacttatctttttacatctctttctctaactctgaaaatgaactgtgaactggagctctcttgaccacgctggtacctaaaattctcccatctcttccccagcaccttccagcgtcctctttacccagcaacagagaatgtcagctctatgatttctctgataggtgaatcccagccatgctgattcctctccacccatttccagtgctagaggcccacagtttcagtctcatctgcctccactcggcctcagttcctcatcactgttcctgtgctcacagtcatcaattatagaccccacaacatgcgccctgaagacagaatgttccatatcagagctgtgatcttgagagccctctccttggctttcctgctgagtctccgaggagctggggccatcaagggtgagtgctcaggaggacgcaggagcgtcggggtgagtgatggggtggttcacatcaattgctgcttcagggatcacagattttaggggctcattgatctatctggtcctcatagtctatgttccctctggccctcataataataacagcaataacagccagaatttatgagactcctgcatagtttctttccccatttacatctcacaggaatcttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcatacactgccttccccagattcctgcacacagtgacctactatcagggccctcctatctctctgggatccccagcctctatcttttgtggctgctttacaggaactccgagctatggactctgcattaggagacgaagtgcaaagagtgtttctgtatcctccctctcttctaggaccctagggctcttcctgggtctttgtgggtggtcacaagctttcctctctcaagacagcagggttgcatggtcttgatagccttgtgattcgggttctgagagattcaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttctaatgttatgttataataaacaccacaataggcttctcttcatagatgcaaatactttttagtattcttggtagaaattcctaatgagctcagctgtctcttcagggcttccctgcccagtctcttaacatttaaacatgtcatttaccttaaaaacataagtgcaaaccaactgataaaaaacaaccttgccttcagtctgcatcctgtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcggcaattctgatttttggcactcttcctggaaaatcttatttaacctgcacctgccactaatgactctcagttctatggcctaaattcctctcctgagaccacccataatccacaaatatctatgtattatttctccttagatgactttcaggtcttctaagtgcaatagccccacagtaaactcagtatcttctcccggtcaggctgtcttccctgagagaagtggcttttgccctgttttctgaatgcctacattgaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcgttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagtttagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacagtttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgagtgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgacctcttaccttcttcctttttatattcataagtctttattcattctctagctttgaccacttgcatattcaaactgacattttgtcgtgtttttctctactgtctttatgcagcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacggtacgccctatctttgcctcttcctctgtagcccaactggaagggatgagagggcctctctgccaccctcagactaggaagcctaagtgccccctgctgtgtgatcctcttcccctagtggccatgggctgatcccactacagcaagggcttgcatcctctcttctcaggagagagaaaggtgagcagagtgaggctggtcagtggtgtgatacccctctctgtgattcagagctgccataaaatctaaggctgaggtagaggaccaccctcccctaagaggtggagcctttgtgattcatcccagaagaggggcctaacctggtgctgtctccttccagatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcgtcctaacatccaattaactggtccataaccttcaattcccacaaccatcccaggccatcaccaccctcactgcacctcctgaccctatctcttcattcttcccccagaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcatggtggaaggcaagtggagccagtgcatcacatggtcatagagggagaaagagacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgctggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggctataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactgtctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacatttactactttaattcatctgggattcatctttgtgtttgatggggatcatgttttatttttctttatataatgggccagtgtgttcccacaactactaaatagttcaccttttccccataggttagtagtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacctggcttaggtgcaaaatttgggggataccaaaagaactcagtaataantcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcactggaggaccagggcatgtgcagggatgaccaccttctccctgggacctgaacagggcagagaaatgggaagctcgggtgcaaagggagtggggaagatgggtccgggcttacagtactgaacccaggaatgacaataactgtgtgtgttgctgcaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttcagagcggggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaattcattgcaatttttaccagccatagtcactccatgtgggagaacttaaatcatgattaccagagctttcaaaggtttgagaatagtgatgattatgaagaaaaatatcttatttgagcaaggattttgtttctttatgagtgttcattagatattacgatgaaaaaagcatgaaatggtaaaaattcagataaatataaaaacatgttctctagttttttttaagttaaaaaaggaattgtttaaagtaaaaattatttgggggtttataacatacccagaagtaaaatatgatgacaatggcacaaagaatagaagggagaaatggaagtataatgttgtaagtttcttatacatgttaagtggtgtgttattatttgaaggtagaatgtattaagatgaatattttaagctcctgataactattgaaaaaaaaagaggtatagccaagaggccaatggagaagataaaatagaacactaagcataattaattcaaaataaagaaataaaaaagggaaagtctggtaagacaaaaagaaaacaaactgtaagatggtagagtttaaaacaaccatactaataattgaattaaatgcacatggcctaaatattctaatgaaaagggaaagattgtcagaatgcacaaaaaaatctacaggccaacttcatgctctctacataatgccctctttaaatatgaaggcaaagacaggtaaaaagtaaaagaatgggaaaatacatgtataccgtggaatgctatgcagccataaaaaaatgagttcatgttgtttgtggggacatggatgaagctggaagccatccttcacagcaaactaacacaggaacagaaaaccaaacaccacacgttctcactcgtaagtgggagttcaacaattagaacacatggacacagggaggggaacacctcacaccagggtctgtcagggcatggggagcaaggggagggagagcattaggacacataccgaatgtattgcatggcttaaaacctagatgatgggttgatagatgcagcaaaccacatggcacatgtataactatgtaacaaacctgcacattctgcacatgtatcccagaacttaaagtaaaaaaaaaaaaaacgaaaataatgccaaccatggaagtattggtggctgtgttaatatcagaaatataagactcagaaatattaccaaggagaaagaaggatagttcataatgataaaagatcattttattatcaacatataacaatcctaaatgtgtttgttctagaaaatatgtcttaaatcacattataccaaaaatgataaaaataaatcagaaatagacaaattcacaattatattttagtattctagcactcagtaaacaataaaatatttaggaaaaaacttcatgaggacatgatagatttaaataacattatcaatgaaccaacgtgatctaatcaagatctgtagaatattccacccaatagtggcagaatacacattattttcaaatgctcaagaatattccacaggacagactatacactgggtcataaacacatataaataaatgtctaaataaataaatgtctctattgaaatcatacagaatacattctcggaccacaatagcattaaattagaaaccaataacagaaaaataccttgaaagtcccaaatacctagaaattaaaaagtatactgctaaacagcacctggatttaaaaagagtcagaaggaaaattagaaaatattttgaactgagtgaatatgaaagcacactatcaaaattagtatgatacactaattacacaataatttataactttacataattggaaaggagggaaactctaaaatcaaccatctatgttcccatcttaagaagctagaaaaaaaaagtcaaatgaatcccaagattaataagatcagaaataaatgcaataaaatggacaaacaataaagaaaataaacaaagtcaattgctggttttcaataaggctcaatacattcatgaatctctaggtagatggatcaagaaaaagagataagactcaaatccccaatatcagaaatggaagtgggtacgtcacaacaaatcatacagacattaaaagtattatgacagaatgctatgaaaatgccaataaacaaaaatgacaataaatttgacaatttacattgttaaattaaattaaatttggtgtaaagctttctccatatcttaaattcctacatagcaaactaacccaacttaacataactgcgttatgcaaacaaactacagcctaacttaagagtgttgtaataaatagctgagtctcagccaatcacaggctgccaagtgatcatattatgtcccccataagcaaatgcctcatcacgccatgcccatataaggcaaacactgagctgtaataaattggctggttttgagtatcacttcctgtttttatctataaacactgccttcacatgttgctggacagagctttctgaatctttctgggttctgagggctccccaattcatgaattgttctttgctaaataaactctgttaaattcaacttctctaaaatttttattttaacaacatgaaatagaaacatttcttgaacgattcaaattaccaaaactaaatcaagaagaaatctctgtcaatggaagaaattaagtttgtaattttaaaaatccttctcacagagaaggccaaatggtttccaggtcagatggcttcattgattaatccatagtattctgtcataatactgtcataatacttttaatgtctgtatgattaattctattatacatttaaggaagaaacaatacaaactcaatacaaactctttcaacaaaagagcagaagaaaacacatcccaataatttacaagtccaatatactaacatcaaacaatgacattaaaagaaaaggaaactaaagacacacaaacatagccatgaaaatgtttaacaaaatattttttaaaattgaattc

SEQ ID NO: 1044 - DNA, 335 bp, Homo sapiens
  Genbank Accession No. X03689
cgcacggttaccaccggaacacgggtatcgtgaaaactacccctaaagccaaaatgggaaaggaaaagactcatatcaacattgtcgtcattggacacgtagattcgggcaagtccaccactactggccatctgatctataaatgcggtggcatcgacaaaaggaccattgaaaagtttgagaaggaagctgctgagatggggaagggctccttcaaatatgcctgggtcttggataaactgaaagctgagcgtgaacgtggtatcaccattgatatctccttgtggaaatttgaaaccgcaaagtactatgtgactatcattgatgccccaggg

SEQ ID NO: 1045 - DNA, 1113 bp, Homo sapiens
  Genbank Accession No. X04201
ttgccccagtctccagttctccagtgttcacaggtgagcctaccaacagccactgctcatgatggaggccatcaagaaaaagatgcagatgctgaagttagacaaggagaatgctctggatcgggctgagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagatgagctctatgcccagaaactgaagtacaaggccattagcgaggagctggaccacgccctcaatgacatgacctctatataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaaaaaaaaa

SEQ ID NO: 1046 - DNA, 835 bp, Homo sapiens
  Genbank Accession No. X05451
gagcctaactactcttagccttccctgctgtgttgctgcccagccgctccatcatgtccttcagtgctgaccagattgctgaattcaaggaggcatttctcctctttgacagaacaggtgattccaagatcaccttaagccaggtcggtgatgtccttcgagccctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaatgtctgctgctctagatgagaagaataaaatattgacaatctcaaatccaagcagccttctttattatctaccatgaatcaacgaaacattcttaaaacaataaatcaataaacaattttggtcagtctg

SEQ ID NO: 1047 - DNA, 4204 bp, Homo sapiens
  Genbank Accession No. X06256
caggacagggaagagcgggcgctatggggagccggacgccagagtcccctctccacgccgtgcagctgcgctggggcccccggcgccgacccccgctcgtgccgctgctgttgctgctcgtgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggcccagcctccctgaagcctttgcattttggagagtttcctgaaacaactggaaagataactaggaaatccattcacagttctttgggccagacatgccacaaggacttcctgtccagctccaacctgcaaagatctgtcctcagccttgccagagatccaaaagaagcccccagtaagaacctggaacttggggagttaagacctggcagctctggacagccccaccctggtgggccaacaaagaacactaactatgcatggtgccccaggaccagctcaggacagatgccacaaggatagatgctggcccagggccagagcccagctccaaggggaatcagaactcaaatggggccagatccagcctggggtctggagttgatctggaacccagactcagacattggcaccaatccaggcagatccaggactatatttgggcctgctccagacctgatcctggaggcccagttcaccctgatttaggagaagccaggaatttcccaggacctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaa

SEQ ID NO: 1048 - DNA, 2574 bp, Homo sapiens
  Genbank Accession No. X06318
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagaggcctttcttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagcttcggaattc

SEQ ID NO: 1049 - DNA, 2520 bp, Homo sapiens
  Genbank Accession No. X06700
  unsure (1)..(2520): n = a or c or g or t
gctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcatatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccagggcctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccttattatggagatgaaccaatggatttcaaaatcaacaccgatgagattatgacttcactcaagtctgctaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaacagtgcaaggtggaccgacaaaattccagttattatttccaaatgtttggaaacagtataatttgacaaagaaaaatgatagttcccttttttgctgttccaccaaatacaattcaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcatgattaatctcctggaagattggtttaaaagaaagtgtaatgcaagaattaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcaccggcatgccacaggggattctcctccttcatcctgtaaaggtcaacaataaaaaccaaattatggggctgcttttgtcacactagcataggagaatgtgttgaaatttaactttgtaagcttgtatgtggttgttgatcttttttttccttacagacaaccataataaaatatanattaaaattca

SEQ ID NO: 1050 - DNA, 1200 bp, Homo sapiens
  Genbank Accession No. X06825
cccgctccgtcctcctcgcctgccaccggtgcacccagtccgctcacccagcccagtccgtccggtcctcaccgcctgccggccggcccaccccccaccgcaggccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagatgaagtctatgcccagaagatgaagtacaaggccattagcgaggaactggacaacgcactcaatgacatcacctccctctgagccccacgcccagcgtgccacctcagctctcttctctcctctcctttccattctctctatggggaggggagagcaggcaggaggagcagaaattgccaacattgcacagccaggctgggagcagcctagggagagcccccatcatgcccaccacccactctggcactggcttcatcctttacctatccccttccaccctcctttgcttgcttaataaattctgaacttggaaaaaaaaa

SEQ ID NO: 1051 - DNA, 6826 bp, Homo sapiens
  Genbank Accession No. X06956
atgcctgtaatcccagcactttgggaggttgaggcgggtggatcgcttgagctcaggagttcaagacaaatctggacaatatggcgagaccttgtctctactaaaaatacaaaaaataaggccgggtgtgggggctcacacctgtaatcccagcactttgggaggctgaagcaggtggatcatctaaggtcaggagttggagaccagcctgaccaacatggtgaaaccccgtctctactaaaaatacaaaaatcatccaggcatccatgcctgtaatcccagctactccagaggctgaggcaggagaatcgctagaacccgcgaggcaggtgttgaggtgagccgaaatcgtgccattgcactccagcctgggcaacaagagcgaaactccatctcaaaaatagataaataaataaaataagctgggcatggtggtggtgcacgcctgtggtctcagctactgaggaggctgaggtggaaggatgaggtagaaggatggccttgagccgggagatggaggttgcaatgagctgagattgcaccactgcactctagcctgggtgacacagcaagacactgactcaaaagagagagagagagagagaaagagaaagcagaagtagcttgaaaagatggggtggagagaacggaatgaaatgtagaaagaagggcttctgcggagaccaggggctgagtgctgagaccattaaggtgcgggttgcagatcctgctcttgggttagagacagaagagaccaagagtcagaatcatccaagatatgagaatctcgattttcttcttttctcttcagaggcaacagacattttgatagcttacaacaatgtttccactatgacatcactgtctccttttcacccacgaaaatgtcaaggactcagtgaggttaagtcacttgctcaaggtcacacagggtagcctggaggagaatccaggtcctgaggtcccccggtcagcgctcccgcagttctggcagcaggggagtgggcaggtgcccgcagcgagggcatcatagtgactgcgctgatgacagcgccactgacccgcgggcggccggcgagccgcggcagattccggggtcggccccggcagacaggctgcggggctcgactctgcgggagcgcctaaggcattggcaatctggggctcaggctgtgcagttctgggtcctcggccgcccacaggcgtcggcgaaaggctgccgccccggccggggaccaggaagcgtcaggcagctggcaagggctccccggggacgcgccacagcctcacagccggcccgagtctcctgggaggcagggctggaagggcaggggtgaaggccagctgtggccgcttgggaaggaccgcctcgcctgctcccgacctaagtcagaacacctggatgaccggtgcctccaggacgcaggtgcaggtgagactcgccctgccacagcaccctgcatctccgcggaggccctcgggagcccagcgtgtctgctcaaaacgaggaaagaatggttaaagcccgaatcgcgactcttaatcccagcgggacaggtgagggacccccgcgcagcttggggagggtaccaggccaggctccgcccctcgggggggccgcttaccctcccgggaggcgtggcctgcgggccgcccagcctctagtgggcgagcggggaacgcgggccccgccccccccccgcctataagggcggtgcggcactgcagctagcgcagttctcactgagacctgtcaccccgactcaacgtgagacgcaccgcccggactcaccatggtgagtgcggcccggccggggtcgcgcctgtcccctaattgcccctgtcctttgggggacacttcttccaggcatgctcggggacctccaccgggcgttccgggtctcaggaggtgcgagggttttgcatcctccctccccaaccccctcctggtgactttggccgagccgtatagttcaccttcggtggctggggttggggcttggggtggagtgcgactcttcagtaacagagaggaacccttcctggcactctgctcctgccttacgagcatttgtgtcccgactctgtatgagagtcacgcgggcccgcgccccgtcctttccgcgggcaaaagaagacgggtttggctgccctcttacatccccagtccctggtcctcagcactgaccgagcacgtgcttggcgctagaaggtggaaggggtcaggttacctggtgccgcatccccctttcctctgtgtatgcattccaactatccacagaaccaccccccccccgtgactcagcaccccgcgtctgagctgagagggttggtgggaacggggttcggcctcctgaagcgagctggccctctccagccgaagcccgggtgcgcggatgggcagagacagctggcgctgagcactgcgcgggccgaggccaggttggggggaggggagagaggtgcatgtagggggtggtatttatagcccaggagcgggggccgaaacccaatccccgctttgggctgggaaataactgtaaagactccagagggagagcggatgtagggctgggctgcaggatggcgcccatcctgcccgggacaaggcgggtcacctctggggcctcaccgcagttccacttcctttctcgggtatttggaaaccgtcaccccgccatttcggtgtgggaagagcgcgcgggccctgccggactttagtgctttaggggttaatttcgggctgacagggacggagcctaaggcagtgagcgccccagtaccctcaaaccttattgctggcccctgctgtctgagcttacaagcattaccgccgctatttccgtgcgggctgacacgggagatgaaagtggtgaagacacccagggtgcgggggtggaggtggggagaggagccagatgggattgatccccagagccagatgggatttaaaggtgagggaggagggcatcctgatggcgtgtggtcagttgatgccagattggatggctgagacacctctgcagcttacaggaaagacagagggaaagggttctatgaattctagctgttcatactcaaagcaaataattaatcaagtggggggggggcctctagctgtaaacccatacctctaggaaaccttttgtcatgtggagccacagtgctcacttgacagattccccactgagaagtgggctaagaggttggcctgcattgctgggtgcctccaggtggggagtcctgtacctgggagcccgggcaggctgctactctcttctcacctctgcccagccccaaccctccactcttgccaactgagtcatcctagctggtagatgatagggtggaagagagactcgcaaggtgaggacttgtggatgtggggctcatgctgtgtcccctctctctatccctcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttttgtggatctggagcctacggtcattggtgagaggaagtggggacaaaattgaagggggtggagcatgactcaaagcttctccctggagagagagggtatttagaccaggcattcctagccctgaaaattcctagccgtacttgaagctgcagaaggcaagctgatctgagactggcctgggcagctggtctgggtttctctcacactctggtatctcaggctggcaggaggatgagtccttccatgcatctggccacagctaccaccctgggggaggaaggtccctgctgagcatagctttgtggtttttgcccttccagatgagatccgaaatggcccataccgacagctcttccacccagagcagctcatcactgggaaagaggatgctgccaacaactatgcccgtggtcactataccattggcaaggagatcattgacccagtgctggatcggatccgcaagctggtgagagtgtgtcttgggagggagggaacttttgagactgtgctaatggtcaggaatattttttttcagatcctttcaggaggtcatctctaactatacatggtctcgagtgtggtgctgctatggcatcctcagtatttgccctgactgctgatgtatcttacgctttatggagccaggtgatagagtccctcaggcccctcccctacctaaactgttctttctcgttcttgcctttcagtctgaccagtgcacaggacttcagggcttcctggtgttccacagctttggtgggggcactggctctggcttcacctcactcctgatggagcggctctctgttgactatggcaagaaatccaagctggaattctccatctacccagccccccaggtgtctacagccgtggtcgagccctacaactctatcctgaccacccacaccaccctggagcactcagactgtgccttcatggtggacaacgaagcaatctatgacatctgccgccgcaacctagacatcgagcgcccaacctacaccaacctcaatcgcctcattagccaaattgtctcctccatcacagcttctctgcgctttgacggggccctcaatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagccagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaaaccggctaggcagctttgactaagctactcaccccaggagtgaaggaaggaaagaactagttgagtgtttttagggggccctagttcttgacacaggcagatgccagcttgagcccaagcagctttaagttttgatctaagacaagctagaactgtccactgctaaccaacctcctgtagaatgaagtcacaccattgccgactctgcaccattcctccttcccaggcagttcgcctgaaatggcaacctgactttgggccccttgcacctcttctctcactccaggaacactgagactaagatctacaccaacctgcttccactttattcttgtttacacattctcctgctcccagatttggagtcagaacactatgtgagctc

SEQ ID NO: 1052 - DNA, 3321 bp, Homo sapiens
  Genbank Accession No. X07109
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccggtcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaaagaaaaaaaaaggtgactcacattgttacacatgctttaaaatatgtgttcaaatgttattaaccacaatgacgacctgttttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgag

SEQ ID NO: 1053 - DNA, 894 bp, Homo sapiens
  Genbank Accession No. X07315
ggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtccttttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacaaaaaaaaa

SEQ ID NO: 1054 - DNA, 1629 bp, Homo sapiens
  Genbank Accession No. X07438
gacagccccactccaatgactttttccctcctaattacccttttaaataaaatttatgaaggttttcataaattttaaaactgatttacacactttaataaaagcatgtgatggacagggagtattaggctgcagattttctacaatgaaattgacgtgagcacatcccagattatcaagtttgggagctgccccctcccccagcctccaagagctccccgcttgctcaggattgacaaatgtgtctctttcttggcagacaacagtgagctgggacggagacaagctccagtgtgtgcagaagggtgagaaggaggggcgtggctggacccagtggatcgagggtgatgagctgcacctggtaggttcctgggctgggtcaggccgggtccccagaggccctgtcattgttgaggtccagatggaccttggaaaaaggcaccatggatgggccttggttctgttctaaagcttctcttccaagggcctggaaaagatgcctgggtgactttaaaaaccaagcaatgtattttcaaggtctaggctgacccaatcatctaatcagagggaagaggtgaggagttatatccattaagcatcagcaatgagctaagcccttttgcattctataactctattctctcagaataggaatatggctcttattttagagatgaggacctgggggctctgaaagattagattacatgtccaaattgcacatctagaaagtggcagaacaaacatttgctcccaaatgatgtatatattcaccatgccaaattgtataggccaaagccaagaaggattctctaagcttctctaagatatgatctcaatctgggtcagcgggaggtgattcgggaggggaagcgtcaaggggtcctgttggtcagctctgagccacatccattcctctcagccagctctgtctgtagggtgctgcagagcactccactatacagtttaactgtctttccaaacaattggttacttaaaccaactcttggggaaaaataacagccaatgagtatttttagagttcttgccgtaagtgtgactctgctctggccaatgaccaacatctgcttttgtttcaggagatgagagtggaaggtgtggtctgcaagcaagtattcaagaaggtgcagtgaggcccaggcagacaaccttgtcccaaggaatcagcaggatgtgtgggccaggatccccctctttgcacagcatgaggcaaaaatgtccagccacccccaggcatctgttagcagagtctgtctcttggctttgtcacttttccttttcttaaaacaaagccatgccaataaagtgatctgtgttcaaaacgtctgtttgggggaagtttcactgcccactgtgctcactttttctccagggcttctgaggccagcttctcctagtgccacccatgggcagagtggataaattcagccacatgtcctgaaattgcaccgtgtttctctccagaggcacaggcttgggtctagaatgggaggtgggagagtggcctgacattcaatcatttgtgtatcaagtagctaccatgttatgtatctaattgtggccaaagtatagtgagtgccacaaagcaggagagtaccttcctcccta

SEQ ID NO: 1055 - DNA, 2511 bp, Homo sapiens
  Genbank Accession No. X12795
cgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaattg

SEQ ID NO: 1056 - DNA, 6807 bp, Homo sapiens
  Genbank Accession No. X14008
tctagagtaagaaactagctgagcaacgtggtgtcacactatacacccattaagacaacaggcacatgtgtcatgtccattttgtggaaaagatatgtaaaataattttaagtaaaaaagataaatataaaaaagtgaatgcatacaaaacaatttcacaaaattgaatgttactcaaaaatcacagctcattttaagctgcacaaaatagtcatttttttctttataattgctcaaattcataatcaaacagaagaaagttcctgtcttggaagtagtgctatgccccaattcttccagagccagtactttaaacaattccatttcattattttcctgtagactaattcttaggacatcagcatatctctcttcaagcattaaaaaaatctctttagagtcagtggatcaatagacagttcctgttttccacacaactgaaagggtggagcccccaaaccacaaggggaagaaggaagttaaaagatgttaaatactggggccagctcaccctggtcagcctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactgtaagtctactctccataattccagagaattagctacgtatggaacagacactaggagagaaggaagaagaagaaggggctttgagtgaatagatgttttatttctttgtgggtttgtatacttacaatggctaaaaacatcagtttggttctttataaccagagatacccgataaaggaatacgggcatggcaggggaaaattccattctaagtaaaacaggacctgttgtactgttctagtgctaggaagtttgctgggtgcctgagattcaatggcacatgtaagctgactgaaagatacatttgaggacctggcagagctctctcaagtccttggtatgtgactccagttatttcccattttgaacttgggctctgagagcctagagtgatgcagtatttttcttgtcttcaagtcccctgccgtgatgtgggatttttatttttatttttattttattttattttatttttaaagacagtctcactgtgtggcccaggctggagtgcagtggcatgatctcagctcactgcaacctctgccttctgggctcaagtgattctcgtgcttcagccttctgagtagctgtgactacaggtgtgtaccaccacacccagctaattttttgtattttcagtagagatggggtttcaccatgttggccaagctggtcttgaactcctggcctcaaatgatctgcccacctcagcctcccaaagtggtaggattacaggtgtgaaccactgcacccagccgacatgggatttttaacagtgatgtttttaaagaatatattgaattccctacacaagagcagtaggaacctagttcccttcagtcactctttgtataggatcccagaaactcagcatgaaatgttttattatttttatctactctacttgattaactatctttcattttctcccacacaattcaagatgtgccatgaggaaaagttattttatagtttagtacatagttgtcgatgtaataatctctgtagttttcagattgaattcagacatttcccctcaatagctatttttgaatgaatgagtgaagggatgaaatcacggaatagtcttgttttcaagattctaacttgatatccaaattcacctttagatattataagaaaatttctatcagaaaatccttatgtttttctgattaaaaaaagcatttttccatcagcctatgtatctgctatgaatttacaaaatctactcaacagctctgttgatttttctgttcttggctgaatgttgcctgagggatgggagcacgggaagggtaaaagcaatggaagaaacatgtattttaatattttaaaagtatgttatattgttcgttggtgttacaagatgatttgcattacaaaaggattctcttacaagtcccttatcttaacactaaagtgctaagatattttataagtaaatctttatacttataaaacaaatcagtaaaatagaagtagctaagtagaactgattttgctatagagtataagtcacttagtgttgctgtttattactaaaaataagttcttttcagggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtggtaagacaagctaatatttgaccaatctggttatacttacaagaattgagactcaatacaaatgaaaaagccttgaaaggttcatgagggacctagaaaaactacatctcaacttccagaaagtcattattattttcctcataattccctgagtaagaaatttaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaacattttgccatagttgcttcttctatgcctttttttttttttttttttttttttgctgagagttttttgtttggttttgttttgttttattttgagacagggtctcctgtccccaggctgtagtcagtggcaccatcacagctcactgcagctcaagtgatcatcccaccacagcctcccaagtagctgggactacaggtgtgcaccaccatgcctggcaaatttttgaaatttttagtacaggcaaattctgtgttgcccaggctggtcttgaactcctgagttcaagcaatcttcccacctcagcctccttaagctgctggaattacaggcgttagcactgtacctggctactgctgagagacttttaagtgaattaggaacatgatgatattccatttctaaattctttagtttacatcttcaaaaaatacagttcctgtagaattattattgtaaataacaaattaacttaaggatttatttatttggagtgaaacaaatattttactgaactcataaaaatagaaataccatgtggaatcctcagtgtcaaaaatattgcagaaatcttgcaaagttgatattattaaattgttaaatattaaaattcccaataaagaacattaatcttatttctaaaatccagttaattaaaaaaatttatattatataataatatttggtcattaaataaaaattagaaaatacaaataagaaaaataacacccataatcttactacccagaggtttataaccatgggtaaattctggtatatattcttccagaatgtatatcaatcatgtgtatgaatgttaaattatatcatacacatataaacccacatacaaacatgtaaatactgtgtgcttttgcaaaaattaaattgtattatacacacggctttacaatttgcttcttatcacacaaaattatttgcatgtcagcaaatacaaatcggtttttaatgatcttttgctccattttccagatgagaaaaaaatacaaatctgtatcatcattttaaaagaatgactagaattttaatatatgaatattctataatttactgatccaattgttactattgagcacttaggttgtttccatttttccctcataaattgctatgaatagctttttgtatacatctttgggtgcatttcttatttcttttggataaattttcaataatagaactgctgagtaaaatatcactaggtgtttttttacagtgtctagtgcaaagaagacctttaatcattttgttaatacttccagagcttccaatgactttggtaaatgaagaaaaaaatgcttcatttcatgctgaatgggagagaatgaagagagttttccccaacaattacacatatatggactcatagaaaataatatcttaccattctttccacagcctaacagaaaaaagctggctaaacctaaatttaaaataaaatatctattaaagtttttattccttaccacctgtctttcagctttgctgcaagataacatcgctgatgctgtagcttgtgcaaagagggttgtccgtgatccacaaggcattagagcatggtatgttttaagtgttaaaagggaaaactatcttactctactgttgatatatacaatgagagcagacttttaaagaccaaagtatgctaatgacacctcaaaattgcagcttttggcttatgctaaatgatgtattacctacatccttgaagaaacaatctactttaactgatccagaatcttactcttttactcctcaatttattttaggggatttctagagttttaagatgcttcacactctatcagttccttgtcatatcttgaaattctttttagaataagtaagtgtgggccgggcacagtgctcacgcctgtaatcccagcactttgggagaccgaggcagatggatcacctgaggtcaggagttcgagaccagcctgcctaacatggcaaaaccccatctccactaaaaatacaaaaaattagctgggtgtggtgcaggtgcctgtaatcccagccactcgggaggctgaggcaggagacttgcttgaacccgggaggtggaggttgcagaggattgcgccattgtacttcagcctgggcgacagagtgagactctgtctcaaataaatagcataaaaaataaacgtggaattcactttgcagttgctgctgtacaacgcacattactcaatctttatgttcggcattctatgctctactgagaaatttgggtaggagtgaagtattttgtatacatatcttcatttaataaatagcaatagctgggtctatcttactattttatctattgataaaatattttgtttccccaaggagtgcgaagtatgtatattacaatgaagatatgttttaacctttcaccatttgcttcatctttttctacagggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttatattaagcctacaacatttttcagtttgcaaatagaactaatactggtgaaaatttacctaaaaccttggttatcaaatacatctccagtacattccgttcttttttttttttttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacatgccttgtctgtttttatttagactcctatagtgtctctgaagaaaagaatacagatatttgaaaaaatatgatttggtgctcttaatatctcttatatcgtcacttacctcacttaaatagtcagatattgctggagaaaaattcacaagcatgctgacaggtctcactttaaattcataaccataaatctcaaatgagccctcaagtctgcctgaccattttagttacttctctacaatccttccatttttatgtccctagtctccaaaatgactgttactattttacttttcctcttctctcttcaaagcctcaagacacacattcagcctcctcctctgcccccttatcctccaccctcctctgctctcagcagataaactggcctcatattacacttctaaaacaaaagcaacttcataccaagctt

SEQ ID NO: 1057 - DNA, 1125 bp, Homo sapiens
  Genbank Accession No. X14046
gtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagcctgatcttctgcttcggcatctggatcctcatcgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctac

SEQ ID NO: 1058 - DNA, 1650 bp, Homo sapiens
  Genbank Accession No. X14830
agcgagccgccacggtatgaccccaggggctctgctgatgctgctgggggcgctggggccgccgctcgccccaggcgtccgcggctcggaggcggagggtcgactccgggagaaacttttctctggctatgatagctccgtgcggccagcgcgggaggtgggagaccgtgtcagggtcagcgttggtctcatcctggcgcaactcatcagcctgaacgagaaggatgaagagatgagcacaaaggtgtacttagacctggagtggactgactacaggctgagctgggaccctgcggagcacgacggcatcgattcgctccgcatcacggcggaatccgtgtggctccctgacgtggtgctactgaacaacaatgatgggaattttgacgtggctctggacattagcgtcgtggtgtcctccgacggctccgtgcgttggcaacccccgggcatctatcgcagcagctgcagcatccaggtcacctacttccccttcgactggcagaattgcactatggtgttcagctcctacagctacgacagctcggaggtcagcctgcagacaggcctgggtcctgacgggcaagggcatcaggaaatccacattcatgaagggactttcattgagaatggccagtgggagaatatccacaagccctctcggctaatccagcctccaggcgatcctaggggagggagggaaggacagcgccaggaagtcatcttctacctcatcatccgccgcaagcctctcttctacctggtcaacgtcattgccccatgcatcctcatcactcttctggccatcttcgtcttctacctgccaccagatgcaggagagaagatggggctctcaatctttgccctgctgacccttactgtgttcctgctgctgctggctgacaaagtacctgagacctcactatcagtacccattattatcaagtacctcatgtttaccatggtcctcgtcaccttctcagtcatccttagtgtcgtggttctcaacctgcaccaccgctcaccccacacccaccaaatgcccctttgggtccgtcagatcttcattcacaaacttccgctgtacctgcgtctaaaaaggcccaaacccgagagagacctgatgccggagccccctcactgttcttctccaggaagtggctggggtcggggaacagatgaatatttcatccggaagccgccaagtgattttctcttccccaaacccaataggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagaccaggccccctgccagttgaagtgagagagtttggtgatactgtcaagccctatccttctctgcctcttaactccttcacgaggaatctgggcctcttatttcgttctggg

SEQ ID NO: 1059 - DNA, 2757 bp, Homo sapiens
  Genbank Accession No. X16316
ctaggcttttgcaaaaagcttcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcagttcctgtgccttaagaacattagaaccttcctgtccacctgctgtgagaagttcggcctcaagcggagcgagctcttcgaagcctttgacctcttcgatgtgcaggattttggcaaggtcatctacaccctgtctgctctgtcctggaccccgatcgcccagaacagggggatcatgcccttccccaccgaggaggagagtgtaggtgatgaagacatctacagtggcctgtccgaccagatcgacgacacggtggaggaggatgaggacctgtatgactgcgtggagaatgaggaggcggaaggcgacgagatctatgaggacctcatgcgctcggagcccgtgtccatgccgcccaagatgacagagtatgacaagcgctgctgctgcctgcgggagatccagcagacggaggagaagtacactgacacgctgggctccatccagcagcatttcttgaagcccctgcaacggttcctgaaacctcaagacattgagatcatctttatcaacattgaggacctgcttcgtgttcatactcacttcctaaaggagatgaaggaagccctgggcacccctggcgcaccgaatctctaccaggtcttcatcaaatacaaggagaggttcctcgtctatggccgctactgcagccaggtggagtcagccagcaaacacctggaccgtgtggccgcagcccgggaggacgtgcagatgaagctggaggaatgttctcagagagccaacaacgggaggttcactgcgcgacctgctgatggtgcctatgcagcgagttctcaaatatcacctccttctccaggagctggtgaaacacacgcaggaggcgatggagcaaggaaactgcggctggccctggatgccatgagggacctggctcagtgcgtgaacgaggtcaagcgagacaacgagacactgcgacagatcaccaatttccagctgtccattgagaacctggaccagtctctggctcactatggccggcccaagatcgacggggaactcaagatcacctcggtggaacggcgctccaagatggacaggtatgccttcctgctcgacaaagctctactcatctgtaagcgcaggggagactcctatgacctcaaggactttgtaaacctgcacagcttccaggttcgggatgactcttcaggagaccgagacaacaagaagtggagccacatgttcctcctgatcgaggaccaaggtgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctcaggacaaaaagaggaatgagctgggtctgcccaagatggaggtgtttcaggaatactacgggcttcctccaccccctggagccattggaccctttctacggctcaaccctggagacattgtggagctcacgaaggctgaggctgaacagaactggtgggagggcagaaatacatctactaatgaaattggctggtttccttgtaacagggtgaagccctatgtccatggccctcctcaggacctgtctgttcatctctggtacgcaggccccatggagcgggcaggggcagagagcatcctggccaaccgctcggacgggactttcttggtgcggcagagggtgaaggatgcagcagaatttgccatcagcattaaatataacgtcgaggtcaagcacacggttaaaatcatgacagcagaaggactgtaccggatcacagagaaaaaggctttccgggggcttacggagctggtggagttttaccagcagaactctctaaaggattgcttcaagtctctggacaccaccttgcagttccccttcaaggagcctgaaaagagaaccatcagcaggccagcagtgggaagcacaaagtattttggcacagccaaagcccgctatgacttctgcgcccgtgaccgttcagagctgtcgctcaaggagggtgacatcatcaagatccttaacaagaagggacagcaaggctggtggcgaggggagatctatggccgggttggctggttccctgccaactacgtggaggaagattattctgaatactgctgagccctggtgccttggcagagagacgagaaactccaggctctgagcccggcgtggcgaggcagcggaccaggggctgtgacagctccggcgggtggagactttgggatggactggaggaggccagcgtccagctggcggtgctcccgggatgtgccctgacatggttaatttataacaccccgattttcctcttgggtcccctcaagcagacgggggctcaagggggttacatttaataaaaggatgaagatgg

SEQ ID NO: 1060 - DNA, 3464 bp, Homo sapiens
  Genbank Accession No. X16354
cagccgtgctcgaagcgttcctggagcccaagctctcctccacaggtgaagacagggccagcaggagacaccatggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctctagggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacagcgagagagagaaagtaaacggcagtaatgcttctcctatttctccaaagccttgtgtgaactagcaaagagaagaaaaccaaatatataaccaatagtgaaatgccacaggtttgtccactgtcagggttgtctacctgtaggatcagggtctaagcaccttggtgcttagctagaataccacctaatccttctggcaagcctgtcttcagagaacccactagaagcaactaggaaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttgggaaatggggctgtgaggaggaggattataacttaggcctagcctcttttaacagcctctgaaatttatcttttcttctatggggcttataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcgaaaaaaaaaa

SEQ ID NO: 1061 - DNA, 1044 bp, Homo sapiens
  Genbank Accession No. X17567
gaattccctgaggaggcgaatccggcgggtatcagagccatcagaaccgccaccatgacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagccaaagaactccaaacaagcagaaagggaagagaagcgagtcctcggtctggtgctgctgcgaggggagaatctggtctcaatgacagtagagggacctcctcccaaagatactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgatgaccccacaaggaagaggtactgttgcagccgctgcagctgctgccacagccagtattgccggggctccaacccagtacccacctggccgtgggggtcctcccccacctatgggccgaggagcaccccctccaggcatgatgggcccacctcctggtatgagacctcctatgggtcccccaatggggatcccccctggaagagggactccaatgggcatgccccctccgggaatgcggcctcctccccctgggatgcgaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgc

SEQ ID NO: 1062 - DNA, 1797 bp, Homo sapiens
  Genbank Accession No. X51345
ccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggcccccctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 1063 - DNA, 269 bp, Homo sapiens
  Genbank Accession No. X51441
ctgcagaagtgatcagcaatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaaaa

SEQ ID NO: 1064 - DNA, 3132 bp, Homo sapiens
  Genbank Accession No. X52541
ccgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaacggtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtatcccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaaaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttttttttttgaaagtgttttttcttcgtccttttggtttaaaaagtttcacgtcttggtgccttttgtgtgatgccccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 1065 - DNA, 1770 bp, Homo sapiens
  Genbank Accession No. X54870
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgcaaaaaaaaaaaaaaaaaaaaaaaaa

SEQ ID NO: 1066 - DNA, 7260 bp, Homo sapiens
  Genbank Accession No. X57025
tcactgtcactgctaaattcagagcagattagagcctgcgcaatggaataaagtcctcaaaattgaaatgtgacattgctctcaacatctcccatctctctggatttccttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaaagtttgttaaaatatgcttgactagagtttcagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacatgttttctgtcatagttagatgtgataattctaagagtgtctatgacttatttccttcacttaattctatccacagtcaaaaatcccccaaggaggaaagctgaaagatgcaactgccaatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaaccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttgcccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttggttttgtttttttttttttttttactttatacagtctttatgaatttcttaatgttcaaaatgacttggttcttttcttcttttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctcttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggactcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacaaaaaaaaaaaaaaaaaaaaaaaa

SEQ ID NO: 1067 - DNA, 1391 bp, Homo sapiens
  Genbank Accession No. X57129
ggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtcttcttgactgccccagacttccttcggagttgggggaattggggacgcctggacgcgttgtttttgtgtttgtggaaaaaataaatgaaggagcatgaagcccgaggcttctgagatcctttcctgaccaaacccaagtgatttggtgtcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctgttacttaaggttagtcgtatgggagttactgaggtatcagacgaattgggtgacggggttggagagtggccgtggtgaggttacagcatttaaacctttattgcggcttctaggtc

SEQ ID NO: 1068 - DNA, 1450 bp, Homo sapiens
  Genbank Accession No. X57348
ccaggcagcagttagcccgccgcccgcctgtgtgtccccagagccatggagagagccagtctgatccagaaggccaagctggcagagcaggccgaacgctatgaggacatggcagccttcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtccccgccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctcttgattcgtaggaattgaggagtgtctccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcaaaaaaaaaaaaaaaaaaaaaaaaaaaaaaaaaaaaaaaaaaa

SEQ ID NO: 1069 - DNA, 915 bp, Homo sapiens
  Genbank Accession No. X57809
ctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagccgctccaacgtcggaagtaataatgttaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcaacatgggatgacagtactgtggtcttcggcggagggaccaagctgaccgtccctggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgc

SEQ ID NO: 1070 - DNA, 2325 bp, Homo sapiens
  Genbank Accession No. X58529
ttttttaaagtaagatgtttaagaaattaaacagtcttagggagagtttatgactgtattcaaaaagttttttaaattagcttgttatcccttcatgtgataactaatctcaaatactttttcgatacctcagagcattattttcataatgagctgtgttcacaatctttttaggttaactcgttttctctttgtcattaaggagaaacactttgatattctgatagagtggccttcattttagtatttttcaagaccacttttcaactactcactttaggataagttttaggtaaaatgtgcatcattatcctgaattatttcagttaagcatgttagttggtggcataagagaaaactcaatcagatagtgctgagacaggactgtggagacaccttagaaggacagattctgttccgaatcaccgatgcggcgtcagcaggactggcctagcggaggctctgggagggtggctgccaggcccggcctgggctttgggtctccccggactacccagagctgggatgcgtggcttctgctgccgggccgactggctgctcagccccagcccttgttaatggacttggaggaatgattccatgccaaagctttgcaaggctcgcagtgaccaggcgcccgacatgggagtgcatccgccccaacccttttccccctcgtctcctgtgagaattccccgtcggatacgagcagcgtggccgttggctgcctcgcacaggacttccttcccgactccatcactttctcctggaaatacaagaacaactctgacatcagcagcacccggggcttcccatcagtcctgagagggggcaagtacgcagccacctcacaggtgctgctgccttccaaggacgtcatgcagggcacagacgaacacgtggtgtgcaaagtccagcaccccaacggcaacaaagaaaagaacgtgcctcttccagtgattgccgagctgcctcccaaagtgagcgtcttcgtcccaccccgcgacggcttcttcggcaacccccgcaagtccaagctcatctgccaggccacgggtttcagtccccggcagattcaggtgtcctggctgcgcgaggggaagcaggtggggtctggcgtcaccacggaccaggtgcaggctgaggcaaaggagtctgggcccacgacctacaaggtgaccagcacactgaccatcaaagagagcgactggctcagccagagcatgttcacctgccgggtggatcacaggggcctgaccttccagcagaatgcgtcctccatgtgtgtccccgatcaagacacagccatccgggtcttcgccatccccccatcctttgccagcatcttcctcaccaagtccaccaagttgacctgcctggtcacagacctgaccacctatgacagcgtgaccatctcctggacccgccagaatggccaagctgtgaaaacccacaccaacatctccgagagccaccccaatgccactttcagcgccgtgggtgaggccagcatctgcgaggatgactggaattccggggagaggttcacgtgcaccgtgacccacacagacctgccctcgccactgaagcagaccatctcccggcccaaaggggtggccctgcacaggcccgatgtctacttgctgccaccagcccgggagcagctgaacttgcgggagtcggccaccatcacgtgcctggtgacgggcttctctcccgcggacgtcttcgtgcagtggatgcagagggggcagcccttgtccccggagaagtatgtgaccagcgccccaatgcctgagccccaggccccaggccggtacttcgcccacagcatcctgaccgtgtccgaagaggaatggaacacgggggagacctacacctgcgtggtggcccatgaggccctgcccaacagggtcaccgagaggaccgtggacaagtccaccgagggggaggtgagcgccgacgaggagggctttgagaacctgtgggccaccgcctccaccttcatcgtcctcttcctcctgagcctcttctacagtaccaccgtcaccttgttcaaggtgaaatgatcccaacagaagaacatcggagaccagagagaggaactcaaagggcgcagctccgggtctggggtcctgcctgcgtggcctgttggcacgtgtttctcttccccgcccggcctccagttgtgtgctctcacacaggcttccttctcgaccggcaggggctggctggcttgcaggcacgaggtgggctctaccccacactgctttgctgtgtatacgcttgttgccctgaaataaatatgcacattttatccatgaa

SEQ ID NO: 1071 - DNA, 1195 bp, Homo sapiens
  Genbank Accession No. X59766
cctggggacaatgtgggcttcaatgtcaagaatgttgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttaaaaaaaaaaa

SEQ ID NO: 1072 - DNA, 1707 bp, Homo sapiens
  Genbank Accession No. X60673
cggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaagcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggacagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttcttttttttttggacatctgttttcactcttaggcttttaaacaatagttattgcttttatccctctcagattctaataactgagagcgatggggctatattgaatctctgtatgcactgagaactgagctatgaagagaatcttattaaactgctggtctgactttatggattgacactgttcctttcttttattgtgaaaaaaaaaaaaaaa

SEQ ID NO: 1073 - DNA, 2152 bp, Homo sapiens
  Genbank Accession No. X62320
gctgctgcccaaggaccgcggagtcggacgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggacaaatggcccacaacactgagcaggcatctgggtggcccctgccaggttgatgcccactgctctgccggccactcctgcatctttaccgtctcagggacttccagttgctgccccttcccagaggccgtggcatgcggggatggccatcactgctgcccacggggcttccactgcagtgcagacgggcgatcctgcttccaaagatcaggtaacaactccgtgggtgccatccagtgccctgatagtcagttcgaatgcccggacttctccacgtgctgtgttatggtcgatggctcctgggggtgctgccccatgccccaggcttcctgctgtgaagacagggtgcactgctgtccgcacggtgccttctgcgacctggttcacacccgctgcatcacacccacgggcacccaccccctggcaaagaagctccctgcccagaggactaacagggcagtggccttgtccagctcggtcatgtgtccggacgcacggtcccggtgccctgatggttctacctgctgtgagctgcccagtgggaagtatggctgctgcccaatgcccaacgccacctgctgctccgatcacctgcactgctgcccccaagacactgtgtgtgacctgatccagagtaagtgcctctccaaggagaacgctaccacggacctcctcactaagctgcctgcgcacacagtgggggatgtgaaatgtgacatggaggtgagctgcccagatggctatacctgctgccgtctacagtcgggggcctggggctgctgcccttttacccaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcaaaaaaaaaaaaaaaaaaaaaaaaaa

SEQ ID NO: 1074 - DNA, 4272 bp, Homo sapiens
  Genbank Accession No. X63741
atactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccctctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtgtgtgtgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaagtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcaaaaaaaaa

SEQ ID NO: 1075 - DNA, 367 bp, Homo sapiens
  Genbank Accession No. X64177
ctccagtctcacctcggcttgcaatggaccccaactgctcctgcgaggctggtggctcctgcgcctgcgccggctcctgcaagtgcaaaaagtgcaaatgcacctcctgcaagaagagctgctgctcctgttgccccctgggctgtgccaagtgtgcccagggctgcatctgcaaaggggcgtcagagaagtgcagctgctgtgcctgatgtcgggacagccctgctgtcagatgaaaacagaatgacacgtaaaatccgaggttttttttttctacaactccgactcatttgctacattcctttttttctgtgaaatatgtgaataataattaaacacttagacttgaaaaaaaaaaaaaaaaaaa

SEQ ID NO: 1076 - DNA, 439 bp, Homo sapiens
  Genbank Accession No. X65614
ggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctgcagagccatggtcccaggcttcccaaaagtgtttgttggcaattattcccctaggctgagcctgctcatgtacctctgattaataaatgcttatgaaaaaaaaa

SEQ ID NO: 1077 - DNA, 6004 bp, Homo sapiens
  Genbank Accession No. X65965
  unsure (1)..(6004): n = a or c or g or t
aagcttgggaaactgggcaactttttctttatttttgtttttatttattattattttggagatggagtttagctctttcgccccaggctacagtgaagtggcttgatcttggcctcactgcagcctctgcccatcccggttcaagtgattctctgccctcagcctcccgagtagctgggattataggtgcctgccacatgcccggctaatttttttgtatttttagtagagaggagtttctccatgttggtcaggctggttttgaactcctgacctcaggtgatccacctgtcttggcctcccaaagtactaagattacaggtgtgagccaccgtgcctggccaacttattttttttctgagttcagtcttctagactatcggttaatacttttgaagttttgtcagttaccagaatatcagatatattcatatgcaaccagtggttttggtatgctgccattttgttaatctgtaccacattccacatttgtgcttataaggatgcatatcctattttaaacccgtagaataagagaagtgagattttgacccagttgatttagttgatgtgactaatctagaattatattctgtattactacagaataaaaggattacagctccttaaagtatacccttagttcagtcgtagagaaaactgcccatcaagacaggaagagctgggctgccttggagaagaacaatgactttattcccaaatggaggcgtagaagaaggagggtagaagtcaaaggaaatttctattcagggaaaagaaaaagctaacagaaagatgtatttttctttccttaacaagatagtaaacgtgagagtgggaatcctctaattctattcagggaaaagaaaaagctaacagagaaagtagtatttctttcctaacaaagatagtacagtgagtggggaaatccctctaacacgattcattaaaaaatgtgaactacgcagctggaggccattatcctaagcgaattaacccaggaacagaaaaccaaatagcccacatgtctcacttgcaagtggaagctaaacatggagtacttatggatataaaaatggcagcaacagacactgaggacagagcgggagggagaagaggggggttgaaactgttgtatacatgctcgctaccttggtgatggctacaattgcaccagacctcagctacatatgaaccgtgtacaactgtgctgtaccttgattaataattgaccggccannnnnnnnnnnnnnnnnnnnnnnnnnnnnnnnnnnnnnnnnaaatccgctgctcgggagctaggcaggagaaatgctgacctgggagggcagaggttgcagtgacccgagatcatggcattgcaactccgccctggggccaccaagagtgaaactccgtcttcaaaagggcaaaaaaacgaaaaaaaaaaaaaaaaaaaaaaaaaaaaagttgaagttataaaaaacaaaaacgtgaattaaaattgtgaaacttagatccaggtgtcgcattctgatgttgtctaatttcttgggccctatgacaaatatattttaatacatgtaatataacatgttactgataattattgaaactctgttcatttgtgggtgttttttaggattttttttttttaataggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggttagatttaaaaattgtgatttcatttgggagagatgctctactgtaaagcattcaactagaaataaggaaaactaacagtgttttaagaacatgtaataatttgcaaatcttaacagataacacccagagtcttgtgtaagaaaaatgttttagaagtctgatatttcataaaattaagtacacgtaattttataggtacattaacaaacatgtttatttttatttattttttttgagacagactctactgttggcccccaggctggagtgcagtggtgcgatctcggnnnnnnnnnnnnnnnnnnnnnnnnnngttaattttcccagtctattttattgttagtatttgtcacattttctttgtaaacagtgaattaaaatattttataggtattcattcttatctagatttcctacttatataaaaaaacaagtgaatgagattgttacaaagggtaattttgtgtgagtagaataataaaagttgaaattgagaagatgcaatgttttagactgaaactgtggttggtttgttttccccttctttctaacaggccttattccactgctgggaattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctgctctttatgactgtttttgtagtggtatagagtactgcagaatacagtaagctgctctattgtagcatttcttgatgttgcttagtcacttatttcataaaccaacttaatgttctgaataatttcttactaaacattttgttattgggcaagtgattgaaaatagtaaatgctttggtggattgaatctgattgggacatttcttcagagagctaaattacaattgcatttataaaaccatcaaaaatattccatccatatacttntggggacttgtagggatgcctttctagtcctatttattgagttatagaaaatctagtcttttgccccagttacttaaaaataaaatattaacactttcccaagggaaacactcggcttttctatagaaaattgcactttttgtcataatcctctgcagtgatacttctggtagatgtcacccagtggtttttgttaggtcaatgttcctgtatatagtttttgcaaatagagctgtatactgtttaaatgtagcaggtgaactgaactggggtttgcctcacctgcacagtaaaggcaaacttcaacagcaaaactgcaaaaaggtggtttttgcagtaggagaaaggaggatgtttatttgcagggcgccaagcaaggagaattgggcagctcatgcttgagcccaatctccatgatgcctacaagctagagtatttaaaggcagtggtaaatttcaggaaagcagaagttaaaggcaaaattgtaaatcagtcgagatcgggtgccttcagggtggtatggctagtataccaaaattgtaaatcactacatgaagcttatatattggtttggcctgaaaggtgaagtgggtaggcagggggcgggcttacaggttatggtggattcaaagactccctgatttgtgattggttaaggaagcaagctttgtctaaaaacttggggtccgcagaaaggaacattaaggtctggccaggcccctcaggaaagaaactgagagcaaagaatggaggtcagatttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctgctcccaaagaggggtccctgactccgtctcacagggatctttttgtatatttggcttagcatcatacatttgccatgttgtttcatcatcttgcctaatttactgtttttgaatatttcatttgtttctaattgttactacagataatgctggggtgagcaactctgtgtacataggtttatctcctattggaatattttctttatataggcgttttttttttttctttttttttggagacagagcttgctctgttgcccaggctggagtgcaggtggccgcgacctggagctccactgcaacctccacttcccgggtccaagtgatgtcccaacctcagcctcctgaatagctgggattataggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttccaagtttcccaagttattttttattttaattttccccagttatttttctatttttttttcatggaaaaatggggtaacttagcagtttcaatattgaagactgaagtttaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagttttgtctttcttgtcttctggatagattgaattttaagagactaagggaatttacaaactaaggaatttagtcatctggtggaaaaggagactttaagattgttagggctgggcggggtgactcacatctgttaatcccctttgggcggccaaggcggcagaacacttgaaggagttcaagaccagcgtggccaacgtggtgaaaccctgtctctactaaaaaatacaaaattgtttagctctgtttttcataatagaaatagaaaaggtaaaattgcttttcttctgaaaagaacaagtattgttcatccaagaagggtttttgtgactgaatcagcagtgcctgcccatgtcatagctgtgcttcaaaaacctcagcatgattagttgtttggagcaaacaaggaagcaaagcaatacgtttttgaaattctatctgttgcttgactatattgtaataattaacattgaagttgagaaattcacaactttaattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcaataccctaatgatcccagcaagataatgtcctgtcttctaagaggtgcatcaagcctggtacatactgaaaaccctataaggtcctggataatttttgtttgattattcattgaagaaacatttattttccaattgtgtgagtttttgactgttaataaaagaatctgtcaaccatcaaagaggtctgcattatgcttgcatgtcaaaaacattaaaaatcctataaatctactgtcattttcactgaagtttccaagggaaaggaattgtaattttgggctgttg

SEQ ID NO: 1078 - DNA, 813 bp, Homo sapiens
  Genbank Accession No. X66141
ttctcgggaggcagtctgggtccttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctctcaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggaaacttggactacaagaacctggtgcacatcatcacccacggagaagagaaggactaggagggggctcgctcgtggaccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtatttggtcacgacatttctctgaaaaaaaaaaaaaaaaaaaaaaaaaaaaa

SEQ ID NO: 1079 - DNA, 1363 bp, Homo sapiens
  Genbank Accession No. X66358
tgttttactccatttcccatcataaggcccattacaggcagctttgcagccttcttcaaattcctcatgccgcagaaccttcatccccaggacgtcccgatagaaacgcgccgtctggaagcggtttcccactttgaatacgaagtgcagacgtctgcgagcagccatgattcccaggcttaagtgatcctttttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactgaaaggctgacatgtgaacagctgttgcatcacccatattttgaaaacatcagagaaatagaggatttggcaaaagaacacgacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaaggagagatgattttaaaaaaggaatcaatagatgctttgaagaaaataaaacttatacagttca

SEQ ID NO: 1080 - DNA, 1552 bp, Homo sapiens
  Genbank Accession No. X66839
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 1081 - DNA, 2390 bp, Homo sapiens
  Genbank Accession No. X66899
agagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggccctcctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaaataaaattccaaatgtttaataaaaaaaaaaaaaaaaaaa

SEQ ID NO: 1082 - DNA, 2000 bp, Homo sapiens
  Genbank Accession No. X68277
tttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcataactgccttgatcaacgtctcagccaattgtcccaaccattttgagggtcactaccagtacaagagcatccctgtggaggacaaccacaaggcagacatcagctcctggttcaacgaggccattgacttcatagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattg

SEQ ID NO: 1083 - DNA, 1943 bp, Homo sapiens
  Genbank Accession No. X72841
gcctcgtcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccacgtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcatttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaat

SEQ ID NO: 1084 - DNA, 214 bp, Homo sapiens
  Genbank Accession No. X72882
ccaaaccatctagttttcataacacctgaagtgtcatgagacagatatcccatgttctcacaataactctttattgtttagctagccccagtgacaagtctgagccagctagccccagtgactttatgcatcttataaccaagaagccttcagtagagcaagtctgagccagaggttttatcacactttgcctcagggtccaccaggaaccagg

SEQ ID NO: 1085 - DNA, 1373 bp, Homo sapiens
  Genbank Accession No. X75962
cgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggaaacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcggggcccagcgtccaccttggtgggcccaggtcagatcttggccagggtggagtggggcccagcataacatacagtgccgccaccagccccctgagccctgtttccccccactactcttccaaatttgtggagacagggctcagggggctggtggcggcactgtatgttatgctgggcatgacggccatgacttcggctatcttctgttttaggtccttgatttcctgatctttctgaaggatttgtccttgggcaatctcgagctgccgctttgcatcgcccagtgcggagaacaggtccagcttgattctcgtctctgcacttaagctgttctccaggtgcgtgtgatttgtcaaaagaaagccttctggatgctgttaagatgtacccttcaggtgaacctggtatcagacccacagtacttgctgtttgagaaaaaataaaaacaaaaaggtcaaaaaaaaaaaaaaa

SEQ ID NO: 1086 - DNA, 3151 bp, Homo sapiens
  Genbank Accession No. X76180
ccggccagcgggcgggctccccagccaggccgctgcacctgtcaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaaaaaaaaaaaaaaaaa

SEQ ID NO: 1087 - DNA, 415 bp, Homo sapiens
  Genbank Accession No. X76717
ccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcmaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaa

SEQ ID NO: 1088 - DNA, 2461 bp, Homo sapiens
  Genbank Accession No. X78706
  unsure (1)..(2461): n = a or c or g or t
agccttcgctgccaggaccgtggtgaagcctctgggcttcctgaagcccttctccttgatgaaggcttccagccgcttcaaggcacaccaggatgccctgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggggcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctggnggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggtttgacaagacgctgcagttcatcgtggcagaagatggctcctgtgggcttgtgtacgagcatgctgcagcngagggtttccctattgtcacccttctggactatgtcatcgagtacacgaagaaacccgagcttgtgcngtctcccatggtgcccctgcccatgcccaagaagctgcggttcaacatcacccccgagatcaagagcgacatcgagaaggccaagcagaacctcagcatcatgatccannacctggatatcaccgtgatggtgttccaccattttggaaaagacttccccaagtcggagaagctaagcccagatgccttcatccagatggctttgcagctggcctactacaggatctacggacaggcatgtgccacctatgaaagtncntccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccggggctacaccgaccgggccatccgcggggaggcctttggtcgacacctgctgggcctgaagctgcaggccatcgaggacctggtgagcacgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtcccccnnaaatgtactgagccacggaccgcatcctccagggacctgcaggccccagccaagtgccttccgtgggtcatcccagcacctgccagggcccgacctggggctgagtgcagaggctgagcaggacgttaggcccgggcccctggcacgtcctccaccggtgcctcctctgggaaagggaaccaccctccagagcaggagactggcaagagctctttgtctcaccagctcagccccggccactccctgccaactccatgaccaggccaccatctgtaccctgcttcccaaactcccaggcctggagacaggattgtctggggncgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 1089 - DNA, 593 bp, Homo sapiens
  Genbank Accession No. X83705
agagagagagagagactgactgagcaggaatggtgagatgtttatcatgggcctcggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgag

SEQ ID NO: 1090 - DNA, 455 bp, Homo sapiens
  Genbank Accession No. X85373
tagacgccgggcctacagcgggaggctgaggaaagccgtgcgttgcgttccaaggacatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgtttactatgatgtaaaaattaggtcatgtacattttcatattagactttttgttaaataaacttttgtaatagtcaaaaaaaaaaaaaaaaa

SEQ ID NO: 1091 - DNA, 2489 bp, Homo sapiens
  Genbank Accession No. X85785
gatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggtgagtatggggccaggccccagagtcccttatccctatgcccctcatttcccctgctgtttgcccctcagtctttatatctcttccttttcctcctcatcttttctcccttcccgcttttttcctcttccttcaaagtctttttccttctctccttcctatgctagcctcctagctccctcttgtgtccctccctttgcctttgagtcagttccatcctggtctcttggtgcctttccttctgaccttgcactgctcctccagccccagctgccctggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatgatgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaagcgggtggtttcttattttgtctggggagaagaaggagaatggagagagagacatttttatgtcagactttcttgccagtgtctgcttctatagctggcttgggaagaaggtgaatgatgaataaataccctcagggtacacagatgttatattgaggtgtggggtcacggccatctcaagggagaagagaagaggaaccagagcatgaggggagtcattaaaccaaaaaaaacagaagggatggcttagctggaaaaaaagctgttatgggaagcaaatggaataggaactcaaactgagagataaacagtgaagagtgatgacaaagcccagagcaataccacctcccctgtccacctgcccagcctctgtcttctgtctcctctctggctttgtttagtgattaggcagtggtgggaggtgaagtagctaccagggtactt

SEQ ID NO: 1092 - DNA, 81940 bp, Homo sapiens
  Genbank Accession No. X90568
attagaggctcaccgattcatgtcggagatggtcagaaaaaccaactctccataggacgtcgtttcagaagcaaccttgggcttagtcccaccctttttaggcactcttgagaaatcagagtgcctagaaagatgacaactcaagcaccgacgtttacgcagccgttacaaagcgttgtggtactggagggtagtaccgcaacctttgaggctcacattagtggttttccagttcctgaggtgagctggtttagggatggccaggtgatttccacttccactctgcccggcgtgcagatctcctttagcgatggccgcgctaaactgacgatccccgccgtgactaaagccaacagtggacgatattccctgaaagccaccaatggatctggacaagcgactagtactgctgagcttctcgtgaaagctgagacagcaccacccaacttcgttcaacgactgcagagcatgaccgtgagacaaggaagccaagtgagactccaagtgagagtgactggaatccctaaccctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctgggcaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtgctgccgccagtgtgtcggccagtgctagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaaataattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtgaagctggcgttgaggtgaaaaaggaagtaggggtgagcatcactggcaccaccgtccgtgaagagcgctttgaagtactgcacggacgcgaagccaaggtaacagaaacagcaagagtaccagcacctgttgaaattcctgttactccaccaactttggtctcgggcttaaaaaatgtgactgtcatagaaggtgaatctgtcaccttggagtgccacatctctggatacccatccccgacagtgacatggtacagggaagactaccaaatcgaaagttccattgacttccagataaccttccagagtggaattgctcgtcttatgattcgcgaagcatttgcggaagacagcgggcgatttacttgcagtgctgtaaatgaggctggaaccgtcagcacatcctgctatctggctgtgcaggtgtcagaagaatttgaaaaggaaaccacagccgtgactgagaaatttactacagaagagaaacgctttgttgagtcaagagatgtggttatgactgatactagcctcacagaggaacaagcagggcctggagaacctgccgcgccttactttattacaaaaccagtggtccagaaactggtggaaggtgggagcgtggtgtttggatgccaagttggcggcaacccaaagccccatgtatactggaaaaaatctggtgttcctctaaccactggatacagatacaaagtgagttacaacaaacaaaccggtgaatgcaagctggtgatttctatgacttttgctgatgatgctggagaatacactattgttgttcgcaataagcatggagaaacttctgcatctgcttccttgcttgaagaagctgattatgagttactgatgaagtcccagcaagaaatgctttatcagacacaagtgactgcatttgttcaagaacctgaagttggagaaacagcacctggatttgtatactctgagtatgaaaaagagtatgaaaaagaacaagccttaattaggaagaaaatggccaaagatactgtagtggtcagaacttatgtagaagatcaggaattccatatttcttcctttgaagagagacttattaaagaaattgaatatagaataataaagactacattagaagaacttcttgaagaagatggagaagaaaagatggcagttgacatttctgaatctgaagctgttgaatcaggatttgatttaagaatcaagaattatagaattcttgaggggatgggtgtcacttttcattgcaagatgtctggatatccattaccaaagattgcttggtacaaagatggcaagcgcatcaaacatggagaaagataccaaatggactttctacaagatggcagagctagtctgcgtatacctgttgttcttccagaagatgaaggaatctacactgcatttgccagcaatattaaaggaaatgcaatttgctcagggaaattgtatgtggagcctgctgcaccacttggagctccgacttacattcccacactagagccagtgagcagaatcagatctctctctccacgttcagtgagcaggtctcctatacgcatgtctcctgcacggatgtcacctgcaaggatgtctcctgcacggatgtcccctgcaagaatgtcccctggacgtaggctggaggagacagatgagtcacaacttgagagactatataaaccagtctttgtgttaaaacctgtttctttcaaatgtttagaaggggcaaactgcagatttgacttaaaggttgttggtagacctatgccagagacgttctggtttcatgatggccagcaaattgtcaatgactatacccataaagtagtcattaaagaagatggtactcaatcactaattattgtccctgccacacccagtgattctggggaatggactgtggttgcccaaaacagggcaggcagatcttcaatttcagtgattttaactgtggaagctgtggaacatcaggtaaaaccgatgtttgtagaaaaactgaaaaatgtcaatataaaggaaggttcccgacttgaaatgaaagtcagagctacgggtaaccccaaccctgacattgtatggttgaaaaacagtgacatcattgtgcctcataaatatcccaaaatcagaattgaaggaaccaagggagaagctgcccttaaaatcgattccactgtcagccaagattctgcctggtatactgcgactgctattaataaagctggcagagacactacaagatgcaaagtaaatgttgaagttgagtttgcagagcctgagccagagagaaagttaatcatcccacgggggacatatagagcaaaggagattgcagccccagaactggagcccctccatttgcgatatggccaagagcaatgggaagaaggtgatctctatgacaaagagaaacaacagaaaccatttttcaagaaaaaactcacttccttaagacttaagcgctttgggcctgcccactttgaatgcaggctaacacccattagtgacccaacgatggtggtggagtggctccatgatggaaagccacttgaagcagccaacaggctccgtatgatcaatgaatttgggtactgcagccttgattatggcgttgcatattctagagacagtggtatcattacttgcagagccactaacaaatatggaacagatcacacatctgctacccttattgttaaagatgagaaaagtcttgtggaagaatcccaattgcctgaggggaggaaaggcttacagagaattgaagaattagagagaatggctcatgaaggtgcacttacaggtgtaacaacagatcagaaagaaaagcaaaagccagacattgtcttgtacccagagccagttagagtacttgaaggggagactgcaaggttccgctgcagggtaacaggctaccctcagcccaaagtcaactggtacctcaatggacagctcatccgcaaaagcaaaaggttcagagttcgctatgatggtatccattacctggacatcgtggactgcaaatcatatgacacaggtgaagtgaaggtcaccgcggaaaatcctgaaggtgtgatagagcataaagtgaagcttgagattcaacagagggaagattttaggtctgtccttaggagagctcctgaaccaaggcctgagtttcacgtacatgaaccaggaaagcttcagtttgaagtacaaaaagtggatagacctgttgacaccactgaaaccaaagaagttgtgaagttgaaaagggctgaaagaattacccatgaaaaagtgcctgaagagtcggaagagctgcgcagtaaattcaagcgcagaacagaagagggctattatgaagccattaccgctgtggagctcaagtctcgaaagaaggatgaatcctatgaggaactcctcaggaagacaaaagatgaacttctccactggaccaaagagttaactgaagaggaaaagaaagctcttgccgaagaaggcaaaatcacgattccaacttttaaacctgacaagattgaactaagtcctagtatggaggctccaaaaatcttcgaaagaatccagagccaaacagtgggccaaggatctgatgcacacttccgggtcagagtcgtggggaaaccagaccccgaatgtgaatggtacaaaaatggtgtcaaaattgaacggtctgaccggatctactggtactggcccgaagacaatgtttgtgaattggtcataagagatgtgactgctgaggactctgccagcatcatggtaaaagccatcaacatagctggagaaacctccagtcacgcattcttacttgtccaagccaagcaattgatcactttcacacaggaattacaagatgttgttgctaaggaaaaagacactatggcaacctttgaatgtgaaacttcagaaccatttgtcaaagtgaaatggtataaagatggtatggaggttcatgagggagataaatacaggatgcactctgacagaaaggttcacttcctctccatactgaccattgatacgtctgatgctgaagattacagctgtgtacttgtggaagatgaaaatgtcaaaacgactgctaaacttattgttgaaggtgcagttgttgagtttgtgaaagaacttcaggacatagaagttccagaatcatattcaggagaattagagtgcattgtatccccagaaaatatagaaggaaaatggtatcataatgatgtggagcttaaatccaatggcaaatatacaattacatctcgtcgtggacgtcagaacctcacggtcaaggatgtaaccaaggaggaccagggagaatacagctttgtcatcgacgggaaaaagacaacctgtaaattaaagatgaaaccccgccccattgctatcctacaaggacttagtgaccaaaaagtctgtgagggtgacattgttcagcttgaagttaaagtctccttggaaagtgtggaaggcgtctggatgaaagacggccaagaagtgcagcccagtgacagggttcacattgtgatagacaaacaatctcatatgctgctcattgaagacatgactaaggaagatgctggaaattactctttcaccattccagcccttggcctctccaccagtgggcgtgtctctgtctatagtgtggacgtgataacacctctaaaagatgttaatgtgattgaaggcaccaaggctgtgcttgaatgtaaggtgtcagtccctgatgtgacttctgttaagtggtacttaaatgatgaacaaatcaagcctgatgaccgtgtacaggccattgtgaaaggtactaaacagcgactagtcattaaccgaactcatgcttcagacgaaggaccttataagctgatagttggcagagttgaaaccaactgtaatctctctgtagaaaaaattaaaattatcagaggtcttcgtgaccttacctgtacagaaactcaaaatgtggtgtttgaggttgagctgtcccactctggaattgatgtcctgtggaattttaaggacaaggaaatcaagcccagttctaaatataaaattgaagcacatggaaaaatatataaattgacagttctaaatatgatgaaagatgatgaaggaaaatacacattttacgcgggagaaaatatgacatctggaaaacttactgtggcaggtggggccatctccaagccactcacagatcagaccgtagctgaatcccaggaagctgtgtttgaatgtgaagttgccaacccagattccaaaggcgaatggttgagggatggcaaacacctaccactgactaacaacatcagaagtgagtctgatggccacaaaaggagacttatcattgctgccaccaaattagatgacattggagaatatacctacaaggtggccacctccaaaacatctgccaaactcaaagttgaagctgtcaaaattaagaagactctgaagaacctcacagtgacagaaacacaggatgctgttttcactgtcgagcttacacaccctaatgtcaaaggtgtccagtggatcaaaaatggagttgtgctggaatccaatgaaaagtatgctatctctgtcaaaggaacaatttactctctgaggattaaaaactgtgccatcgtggatgagtctgtttatggcttcaggcttggaaggcttggagccagtgccagactgcacgtggagactgtcaagatcattaaaaagccaaaggatgtgacagccttggaaaatgccactgttgcctttgaagttagtgtttcccatgacactgttccagtaaaatggttccataagagtgtggaaattaagccaagtgacaaacacagactggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcactccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctgggaagtacacagtggtggcaggaggcaacgtgtcaactgcaaaactctttgtagaaggcagagatgttcgcatccgaagtattaaaaaggaggttcaggtcattgagaaacagcgtgctgttgttgaatttgaggtcaatgaagacgatgttgatgcccactggtataaagatggcattgaaatcaatttccaagttcaagaacgacacaaatatgtagtggaaagaagaatccaccgaatgtttatctctgagaccagacagagcgatgcaggagaatacacctttgtggcaggaaggaacaggagttctgtcactctctatgtcaatgctcctgaaccgccccaagttctgcaggagctccagcctgtcactgtgcagtctggcaagcctgcccgcttctgtgccatgatatccggaagaccacagcccaaaatttcctggtacaaggaagagcagctgctttccactggcttcaagtgcaaatttcttcatgatgggcaagagtacacgcttttgctaattgaagccttcccagaggatgcggcagtctatacctgtgaagccaagaatgactatggtgttgccacaacatcagcttcactctcagtggaagttccagaagttgtgtctcctgatcaggaaatgcctgtttatccacctgccatcatcaccccgcttcaggacactgtcacttctgaagggcagccagcccgttttcaatgccgggtttctggaacagatctaaaagtgtcgtggtacagcaaagacaagaaaatcaagccatctcggttctttagaatgactcaatttgaagacacttatcaactggaaattgccgaagcttatccagaagatgaaggaacttacacgtttgttgctaataatgctgtaggccaagtatcaagcacagccaacctgagtctggaagctcctgaatcaattttgcatgagaggattgaacaagagattgagatggaaatgaaagagttttctagttcttttctgtctgccgaggaagaaggacttcatagcgccgaacttcaattatctaaaataaatgaaacacttgaacttttgtctgaatctccagtttacccaactaaatttgattccgaaaaggaaggcactggcccaattttcatcaaagaagtgtcaaatgctgatataagcatgggggatgtggctacactgtctgtaactgtcattggcatccccaaacctaaaattcagtggttctttaatggagtgctattaaccccttctgctgactacaaatttgtttttgacggtgatgatcatagcctgatcattctgttcaccaaattggaggatgagggagagtatacatgtatggccagtaatgactatggaaagacaatatgtagtgcctatctaaaaattaattccaaaggagagggtcacaaagacactgaaacagaatcagcagtggcaaaatctctggaaaagctgggaggtccttgtcctcctcacttccttaaggagttaaaaccaattcgctgtgctcaagggcttcctgccatctttgagtacacagtggttggagagcctgcccctactgttacatggttcaaagaaaacaagcagctttgcaccagtgtttattacactatcattcataaccctaatggctctggaactttcattgtcaatgaccctcagagggaagacagtggcctctatatctgtaaagcagagaatatgttgggtgagtccacctgtgcagcagagctgcttgtgcttctggaagacacagacatgactgataccccctgcaaagcaaagtccacaccagaggctcctgaggattttccacagacacccttaaagggtcccgcagttgaagcacttgactcggagcaggaaattgcaacgtttgtaaaagacaccattttgaaagctgctttaattacagaagaaaaccagcaactatcttatgagcatattgctaaagccaatgaattgagcagtcagcttcctttgggagctcaggaattgcaatccattttggagcaagacaagctcactcctgaaagcaccagggaatttctttgcatcaatggcagtattcactttcagcctctcaaggaaccatctcccaacctacagctgcagattgtacagtcccagaaaaccttctccaaagaaggtattctaatgcctgaagagcctgagacacaggcagttctatcagataccgagaaaatcttcccaagtgccatgtccatagaacaaattaattcattaacagttgagcctctgaaaactttattagctgaacctgaagggaattatccacagtcttcaatagaacctccaatgcattcttatctaacctctgtggctgaggaagtactttcactaaaagaaaagacagtatctgacaccaacagagagcaaagagtgactcttcaaaagcaagaggcacaaagtgcgctcatcttgagtcagagcttagctgagggacacgtggagagtctccagagtcctgatgtcatgatctctcaggtaaactatgagcccctagtcccttcagaacactcatgcacagaaggaggtaaaattttgatagaaagtgcaaatccactggaaaatgcagggcaagattctgcggtcagaattgaggaaggcaagtccttaagatttccactagcacttgaagaaaagcaggtactgctcaaagaagagcattctgacaacgtggtgatgcccccagaccaaatcattgagtctaaaagagagcccgtggcaataaagaaagtgcaggaggtacagggaagggaccttctttctaaggaaagcttgctttctggtattccagaagagcagagattaaacctgaaaattcaaatctgccgggctttgcaagcagccgtggccagcgagcagccaggtcttttctctgagtggctaagaaatattgaaaaggtggaggtcgaggctgtaaacatcacccaagagcccagacacatcatgtgcatgtaccttgttacttcggcaaagtctgtaacagaagaagtaaccatcattattgaagatgttgatcctcaaatggctaacctgaaaatggaacttagggatgctttgtgtgctattatatatgaggaaatagacatcctaacagctgagggtcctagaattcagcaaggagccaaaacaagtttgcaagaagaaatggattctttttcaggttcacagaaggttgaacccattactgaaccagaagttgaatctaaatatctgatctcaactgaagaggtcagttattttaacgtgcaaagtagggttaaatatttggatgccacacctgtcactaaaggggttgcttcagctgttgtctctgacgaaaaacaagatgagagtctgaaaccatcagaggaaaaagaggagtcttcctctgaaagtggtactgaggaggttgctacagtaaagatacaggaagctgagggtggcttaatcaaagaggatggccccatgatacatacacctttagtggacactgtttctgaggaaggtgatattgtacacctcacaacatccataacaaatgctaaagaggtgaattggtattttgagaataaactggtgccttcagatgaaaagttcaagtgtttacaagatcaaaatacatatacgctagtcatcgacaaagtaaataccgaagaccatcaaggagagtatgtctgtgaggccttgaatgacagcggaaaaacagcaacttcagccaaactcactgtagtaaaaagagctgccccagtgatcaagaggaaaatcgaacccctggaagtagcactgggccacctagccaaattcacctgtgagatccaaagtgctcccaatgtccggttccagtggtttaaagctggccgagaaatttatgagagtgacaagtgttctattcgatcttcaaagtatatctccagccttgaaatcctgagaacccaggtggttgactgcggcgagtatacatgcaaagcttccaatgagtatggcagtgtcagctgtacagccacactaactgtgacagtgcctggaggtgaaaagaaagttcgcaaattacttccggaacgtaaacctgaaccaaaggaagaagttgttctgaaaagcgttctaagaaaaagacctgaagaagaagaacctaaagtagaacctaaaaaactagaaaaagttaaaaaacctgcagtaccagaaccaccacctccaaaacctgttgaagaggttgaagtacctactgttacaaaaagggaaaggaagattcctgaaccaacaaaagtgcctgaaatcaagccagcaatacctctccctgcacctgaaccgaaaccaaagcccgaagcagaagtgaaaacaatcaaaccacctcctgtggaacctgaaccaacccccatcgctgccccagtaacagtgccagtggttggaaagaaagcagaagccaaagcacctaaggaagaggctgccaagccaaaaggtcctatcaaaggtgtacccaaaaagactccttcaccaatagaagccgaaaggagaaagttaaggccaggaagtggtggagagaaacctcctgatgaagccccgttcacctaccagctaaaggctgtgccactgaagtttgtgaaagaaatcaaagacatcatcttgacagaatcagagttcgttggctcttcagcaatctttgaatgtttggtctccccttccactgcaattacaacctggatgaaagacggtagcaatatccgtgagagtcccaagcacaggtttattgcagatggtaaagacagaaagctgcacatcattgatgttcaactttccgatgctggtgaatacacctgtgttttacgtttgggaaacaaagaaaagacctccacggctaaacttgttgtagaagaacttcctgtgcgttttgtaaaaacactggaagaggaagtcacagtggtcaaaggacagccattgtacttgagctgcgagttaaacaaagagcgtgacgtggtctggaggaaggatggcaagattgtggtggagaaacctggccgaattgtgccaggcgtcattggcttgatgcgggctctgaccatcaacgatgcagatgacacagatgctggaacatacacagttactgtggaaaacgccaacaacctggagtgttcatcttgcgtaaaagtagtagaagtcattagagattggctggtgaaacctatacgagaccagcatgtgaaacccaaggggacagctatttttgcctgtgatatagcaaaagatactccaaacattaagtggttcaaaggatatgatgaaatccctgcggaaccaaatgataagactgaaatactgagagatggaaatcatctgtacctcaaaattaagaatgctatgccagaagatattgctgagtatgcagtggaaattgaaggaaaaagataccctgcaaagctgacacttggagagcgtgaagttgaactgcttaaaccaatagaggacgttaccatttatgagaaagaaagtgcaagctttgatgcagaaatctcagaggcagacattcctggacaatggaaactgaaaggagaacttctaaggccctcacctacttgtgaaatcaaagcagaaggtggaaaacgcttcttaactttgcacaaagtcaaactggaccaagctggtgaagtcctctaccaggcccttaatgcaattacaactgccattttgacagtaaaagaaatcgaacttgactttgctgtgcccctgaaggatgtcactgttccagaaaggcgacaggctcgattcgaatgtgtcctcacccgagaggcaaatgttatatggtccaaaggacctgatataattaagtcatctgacaaatttgatatcatcgctgatggaaagaaacatattcttgttattaatgattctcaatttgatgatgaaggggtctatactgctgaggtggagggcaagaagacctcagctcggttgtttgtcacaggtataagactgaaattcatgtcacctcttgaagatcaaacagtaaaagaaggtgaaacagcaacttttgtttgtgaactttctcatgaaaaaatgcatgtagtctggttcaaaaatgatgccaaactccatacaagcagaacagtactcatctcttctgagggcaagactcacaaattggaaatgaaagaagtgacattggatgatatatctcagataaaagctcaagtcaaggagctgagctccacagcacagctgaaggtcttagaggccgatccctacttcactgtgaaattacatgacaaaactgcagtggagaaggatgagattactttgaagtgtgaagtgagcaaagatgtaccagtgaaatggttcaaagatggtgaagagattgtcccttcacccaaatattctatcaaggcagatggcctgcgccgcatcttaaaaatcaaaaaggcggaccttaaagataaaggcgaatatgtgtgtgactgtggcacagacaagaccaaggcaaatgttactgttgaggctcgactaatagaagtggaaaagcctctgtacggagtagaggtgtttgttggtgaaacagcccactttgaaattgaactttctgaacctgatgttcacggccagtggaagctgaaaggacagcctttgacagcttcccctgactgtgaaatcattgaggatggaaagaagcatattctgatccttcataactgtcagctgggtatgacaggagaggtttccttccaggctgctaatgccaaatctgcagccaatctgaaagtgaaagaattgcctcttatcttcatcacacctctcagtgatgttaaagtcttcgagaaagatgaggctaagtttgagtgtgaagtatccagggagcccaaaacattccgttggctaaaaggaacccaggaaatcacaggtgatgacagatttgagcttataaaggatggcactaagcattcaatggtgatcaagtcagctgcttttgaagatgaagcaaaatacatgtttgaagctgaagataagcacacaagtggcaaactgatcattgaaggaatccggctcaaattcctcacccctctcaaagatgtaactgccaaagagaaggaaagtgctgtatttactgtggagttatctcatgataacatccgagttaaatggttcaagaatgaccagcgcctacacaccaccaggtcggtctcaatgcaagacgaagggaaaactcattcgatcacattcaaagacctgtctattgatgacacctcccaaattagagtagaagctatggggatgagttcagaagctaaactcactgtgcttgagggagacccatattttacaggaaaacttcaagattatactggtgtagagaaagatgaagttattctacagtgtgaaattagcaaagcagatgcaccagtgaaatggtttaaggatgggaaggaaataaagccatccaaaaatgctgttattaagacagatggcaagaaacgcatgctaatcctaaagaaagccttgaaatcagatattggacagtacacctgtgactgtgggacagataagacctcaggaaaacttgacattgaggatcgggaaattaaactggtgcgacccctgcacagtgtggaggtgatggagactgagacagcacgctttgaaaccgaaatctctgaagatgatatccacgccaactggaaactcaagggagaggccctactccaaacacctgattgtgaaattaaggaagaaggcaaaatacactcccttgttttgcacaactgtcgcctggaccagacgggtggggtggatttccaagctgccaatgttaaatctagtgcccacctccgagttaagccacgagtaattggtcttctgaggcctttaaaggatgtcaccgtgactgcaggggaaacagccaccttcgactgcgagctctcctacgaagatatcccagtggaatggtatctcaaagggaagaaactagagcccagcgataaggtggtcccacgttcagaaggaaaagttcatacacttactctgagggatgtaaagttagaagatgctggggaagtccaactaacagcaaaagatttcaaaactcacgccaacctctttgtgaaagaacccccagttgaattcactaagcctcttgaggaccagacggtcgaagagggagccactgcagtgctggagtgtgaagtctccagagaaaatgctaaggtgaaatggttcaaaaatgggacagaaatcctcaaaagcaagaagtatgaaattgttgctgatggcagggtcagaaaacttgttatacatgactgtaccccagaggatattaaaacatacacttgtgatgctaaggattttaagacttcctgtaacctgaatgtcgtgcctcctcatgtggaattcttaagaccactcaccgaccttcaagttagagaaaaagaaatggctcgatttgagtgtgaactttcccgagaaaatgctaaggttaagtggtttaaagatggtgctgaaattaaaaagggcaaaaaatatgacatcatatccaagggagcagtgcgcattcttgtcatcaacaaatgtctactggatgatgaagctgaatattcctgtgaagtaaggacagcgagaacttctggcatgctgacagttctggaagaagaagctgtctttaccaaaaatcttgccaacattgaagttagtgaaacagacactataaaactggtttgtgaagtctccaaacctggcgcagaagtgatttggtataaaggggatgaggagatcattgaaacaggaagatatgaaatactgactgaaggacggaagagaatcctggtcattcagaacgctcaccttgaggatgctggcaactacaactgtcgactcccaagctctcgaaccgatggcaaagtcaaagtacatgaactggctgctgaatttatctcaaagcctcaaaaccttgaaatacttgaaggagaaaaggctgaatttgtctgctctatatcaaaagaaagctttccagtccagtggaagagggatgataagacacttgaatctggagataaatatgacgttattgctgatggtaaaaagagggtcctagttgtgaaagatgccacattacaagatatgggcacttacgttgtcatggtaggggccgccagagcagcagctcacttgacagtcattgaaaaactcaggatcgtagttcctcttaaggacacccgggtgaaggaacaacaggaagttgtcttcaactgtgaagtcaatactgaaggtgccaaagccaaatggttcagaaatgaagaagctatatttgatagttcaaaatacatcattctccaaaaagacctagtctacaccctcagaattagagatgcacacttagatgaccaagccaactataatgtgtctttgaccaatcacagaggtgaaaatgttaaaagtgcagccaatctaatagtagaagaggaagaccttaggattgttgagcctcttaaagatattgaaacaatggagaagaaatctgtcacattctggtgcaaggtgaatcgtctcaatgtaacactgaagtggaccaaaaatggtgaagaagtgccttttgacaaccgtgtctcatacagagttgataagtacaagcacatgttaaccattaaagactgtggcttcccagatgaaggtgaatacattgtcactgctggacaagataaatctgttgctgagcttctcatcatagaagccccgacagaatttgtggaacacttggaagatcagacagtcactgagttcgatgacgctgtcttctcctgccagctctccagagagaaagccaatgtaaaatggtacagaaatgggagagaaatcaaagaaggcaaaaaatacaaatttgaaaaagatggaagtatacacagactcattataaaagattgcaggctggatgatgagtgtgaatatgcttgcggggtagaagacaggaagtctcgtgctagactttttgtggaagaaattcctgttgagatcatcaggcctccacaagatattcttgaagcccctggtgctgatgttgtctttttagcagaactcaataaagataaggtggaagtccaatggctaagaaataacatggttgttgtccagggtgataaacaccagatgatgagtgaaggaaagatacatcgactacagatttgtgatattaagccccgtgaccagggtgaatacagatttattgccaaagacaaagaagccagagctaagcttgaactggcagctgcaccaaaaatcaagacagctgaccaagaccttgtggttgatgttggcaagcctctgacaatggtggtgccatatgatgcctaccccaaagcagaagctgaatggtttaaagaaaatgaacctttatctacaaaaaccattgatactacggctgaacaaacttctttcagaattttagaagccaagaaaggagacaaagggaggtataaaattgtgcttcagaacaaacatggaaaagcagaaggattcatcaatttaaaagttattgatgttcctgggccagtacgtaacttagaagtgacagaaacatttgatggtgaagtgagccttgcttgggaagaacctttaactgatggtggaagcaaaatcataggttacgttgttgaaagacgtgacattaagagaaagacctgggttctggccacagaccgtgcagagagttgtgagtttactgtcactggtctacagaaaggaggagttgagtacctattccgtgtgagtgcaagaaacagagttggcactggtgagccagtagaaactgacaatcctgtagaagcaaggagtaaatatgatgttccaggccctcctttgaatgtaaccatcactgatgtgaatcgatttggtgtctcactgacatgggaaccaccagagtatgatggaggtgctgagatcacaaactacgtcattgaattaagagacaagacttctatcaggtgggatactgccatgactgtgagagctgaagacctgtctgcaactgttactgatgtggtagaaggacaggagtacagtttccgagtgagagcccaaaatcgaattggagttggaaaaccaagtgcagccacacccttcgtcaaagttgctgatccaattgagagaccaagtcctcctgtaaacctaacttcctcagatcagactcagtcatcagttcagctcaaatgggaacctcctctgaaagatggaggaagcccaatattaggctatataattgagcgatgcgaagaaggaaaagataattggattcgttgcaatatgaaacttgtccctgaactgacttacaaggttaccggattggaaaaaggaaataaatatttatatagagtatctgcagaaaataaagctggtgtttcagatccatctgaaattcttggtcctctcaccgctgacgatgcatttgttgaaccaacaatggatttaagtgcatttaaagatggtctggaagttattgtcccaaatcctatcacgatcctggttccaagtacaggctatccaaggccaactgcaacctggtgttttggagataaagtactagaaacaggggaccgggtgaaaatgaagaccttgtctgcctatgccgaacttgtcatttctccaagtgaacgttcagacaagggcatttatacactgaaattagaaaaccgtgtgaaaacaatttctggggaaattgatgtcaatgtaattgctcgcccaagtgcacccaaagaattgaaatttggtgatataaccaaggactcagtacatttgacttgggaaccacctgatgatgatggaggaagtccgttaactggatacgttgttgaaaaacgagaagtcagccggaaaacatggactaaagttatggactttgtgactgatctagaattcacagttcctgatcttgttcaaggaaaagagtacttatttaaagtttgtgctcgtaacaaatgtggccctggagaacctgcatatgttgatgaacctgtaaatatgtcaactcctgcaacggtacctgacccaccagagaatgttaaatggagagatcgaacagccaatagcatcttcttaacatgggatccacctaaaaatgatggtggttcacgcatcaaaggatatatagttgaaagatgtccacgtggttctgataaatgggttgcctgtggagaacctgttgcagaaacaaaaatggaagtgacaggtcttgaggaaggcaaatggtatgcctaccgcgtgaagaccttaaacaggcagggtgctagcaaaccaagcagacccacagaggaaatccaggctgtggacacacaagaggccccagaaatcttcctcgatgtgaagctccttgctggtctcactgtaaaagctgggaccaagattgaacttcctgccaccgtaaccggaaaacctgaacctaaaataacttggacaaaggctgatatgattctgaagcaggacaaaagaattaccattgaaaatgtccctaagaaatccacagtgactattgttgatagtaagagaagtgacactggcacatatatcattgaggctgtgaatgtgtgtggccgggccactgctgtggtggaagtgaacgtcttagataaacccggaccaccagctgcctttgacatcacagatgtaaccaatgagtcatgtcttctaacatggaacccaccacgcgatgatggtggatctaagatcacaaactatgttgtggagagacgagcaactgatagtgaagtgtggcacaagctctcatccaccgtcaaggatacaaacttcaaggccaccaaattaatccccaataaagagtacatcttcagagttgctgcagaaaacatgtatggtgctggtgaaccagttcaggcctctccaataacagccaaatatcagtttgatccacctggtcctccaactcgcctagaaccttctgatatcactaaagacgcagtgactctcacatggtgtgagccagatgatgatggtggcagcccaatcacaggatactgggttgaaagactggatcctgatacagataaatgggttagatgcaataagatgccagtaaaggacacaacatacagagtgaaaggtctcactaataagaaaaaatacagattccgtgtgttggctgaaaatcttgctggacctggaaaaccaagcaaatcaactgaaccaatcttaataaaggatcccatagatcctccatggccccctggaaaaccaactgtaaaagatgtaggcaaaacatcagtaaggttgaattggacaaaaccagaacatgatggaggtgcaaagattgagtcttatgtcattgaaatgctgaagactggaacagatgagtgggtcagagtggcggaaggggttcccaccactcagcacttgctcccagggctcatggaaggacaggaatactcattccgagttagagctgtgaataaggctggggaaagtgaacccagtgaacccagtgaccctgtgctttgccgggagaagctatatcctccatcaccaccacgctggcttgaagttattaatatcacaaaaaatacagcagacctaaaatggacagttcctgagaaagatggagggtcccccatcaccaactacattgtggaaaagagagacgtcaggcgaaaaggctggcaaacagtggataccactgtcaaggacaccaagtgcacagtcaccccactgactgagggctctttatatgtgttccgagttgctgcagaaaatgctataggacaaagcgactacaccgaaattgaggactctgtgctggccaaagacacctttaccactcctggaccaccctacgccctggcagtggttgatgtgacaaaacgacatgttgacctaaagtgggagccacctaaaaatgatggtggaagaccaatacagagatatgtcattgagaagaaagaaaggttaggtacccgttgggtgaaagctggaaagactgcaggacctgactgtaacttcagagtaactgatgtcatcgaaggaacagaggtccagtttcaggttcgggctgaaaatgaagctggagttggccacccaagtgaacccacagaaatcctatccattgaagatccaacaagtcctccctcaccaccccttgacctacatgtgactgatgctgggagaaaacacattgccattgcttggaagcctccagagaaaaatggtggaagtcctatcataggataccatgttgaaatgtgtccagtaggcactgagaaatggatgagagttaattctcgcccaataaaggacttgaaattcaaggttgaagaaggtgttgttcctgacaaagaatatgtcctgagagtgagagcagtcaatgctattggtgtcagcgagccatctgaaatctctgaaaatgtggttgccaaagacccagactgcaagccaacaattgacctggagactcatgacattattgttattgaaggtgaaaagttaagcattcctgttcccttcagagctgtcccagttccaactgttagttggcataaagatggcaaagaagttaaagcaagtgatagattaacaatgaagaatgatcacatctctgcacaccttgaagttcccaagagtgtccgtgcagatgccggaatttataccattacactggagaataagctcggctcagcaacagcctcaatcaatgtcaaagtcataggcctacctggaccatgcaaagatattaaagcaagtgacattaccaagagttcttgtaagttaacttgggaacctccagaatttgatggtggaaccccaattcttcattatgtcctggagcgcagagaagctgggaggagaacatatataccagtcatgtctggtgagaacaaactgtcatggactgtgaaggatctcataccaaatggtgaatacttcttccgtgttaaagcagtcaacaaggttggtggaggagaatatattgaactgaaaaatccagtcattgctcaagatccaaagcaaccccctgatccacctgtagatgtagaggttcataatcctacagcggaggcaatgactattacatggaagccacctttgtatgatggagggagcaagataatgggctacatcatagagaagattgctaagggtgaagaaaggtggaagagatgcaatgaacacctggtaccaatcctgacctatacagcaaaaggacttgaagaggggaaagagtaccaattccgtgtgcgagcagagaacgccgcgggtattagtgaaccttctcgggctactcctccaaccaaagctgtagatcccattgatgcccccaaagtcattctgagaacaagcctagaagtgaaacgaggtgatgaaatagcacttgatgcaagtatttctggatcaccttacccaactattacatggataaaggatgaaaatgttattgtaccagaggaaattaagaagcgtgcagcacccttggttaggagaaggaagggtgaagttcaagaagaagaaccatttgtcctgcctctgacacagcgtttgagtattgacaacagcaaaaagggagaatctcagctacgcgtccgagattctctccgacctgaccatggtctgtatatgatcaaagttgaaaatgaccacggtattgcaaaagctccttgtactgtcagtgtgttagatacaccgggaccaccaatcaactttgtatttgaagatatcagaaagacctcagtcctttgtaaatgggaaccaccccttgatgatggtggcagtgaaatcataaactacactttggaaaagaaagacaagacaaaacccgactcagaatggattgttgtcacttcaacacttagacattgcaaatattcagtaacaaaactgattgaaggaaaagagtacctcttccgtgtaagagctgaaaacagatttgggccaggtccaccatgtgtttcaaagccacttgtggctaaagatccatttggaccacctgatgcaccagataagcccattgtggaagatgttaccagcaacagtatgctagtgaaatggaatgaaccaaaagataatggaagccccattttgggttactggcttgaaaaacgtgaagttaacagtacacattggtctcgtgtcaacaaaagccttctgaatgccttgaaagccaatgtagatggcttattagaaggactcacctatgtcttcagagtatgtgctgaaaatgcagctggacctggaaagttcagtccaccttcagatcccaaaacagcacatgatccaatctctcctcctgggccacctatcccaagagtcactgacacaagctctacaactattgaactagaatgggaacccccagctttcaatggtggtggggaaattgttggctattttgttgataagcagttggttggcacaaataaatggtcacgctgcacagagaagatgatcaaggtccgtcagtacaccgtcaaagaaatccgagagggtgctgattacaaacttcgggtgagtgctgtcaatgccgcaggggaaggaccgcctggagaaacacaacctgttactgtggctgaaccacaagagcctccagctgtggaactggatgtttctgtcaagggtggaatacaaataatggctgggaagactcttagaattccagctgtggtgactggtcgccctgtacctacaaaagtatggaccaaagaagaaggggagctggataaagaccgtgttgtaatagacaacgttggaaccaaatctgaactaattatcaaggatgcactgcgaaaagaccatggcagatatgtgattacagctacaaatagctgtggttccaaatttgcagcagccagggtagaagtttttgatgtccctggtccagttcttgacttaaaacctgttgtaacaaacagaaaaatgtgtctacttaactggtctgatccagaagatgatggaggaagtgaaataacaggctttatcattgaaagaaaagatgccaagatgcatacttggagacaaccaatagagactgagagatctaaatgtgacatcacaggtctgcttgagggacaagaatataagttccgtgttattgccaagaacaagtttggctgtggccctcctgttgaaataggaccaattcttgcagttgatccactaggtcctccaacatctccagagaggctcacatacactgaaagacaaaggtccactatcacacttgactggaaagagccccgcagtaatggtggcagtcccatccaaggatatatcattgaaaaacggcgtcatgacaaacctgactttgaaagagttaacaagcgactctgcccaaccacatcttttctggttgaaaatcttgatgaacaccaaatgtatgagttccgtgtcaaagctgtcaatgaaattggtgaaagtgaaccatccctacctcttaatgtagtcatacaagatgatgaagtgcctccaactattaagttgcgtctgagtgttcgaggagacactatcaaagttaaggcaggagagcctgtccacatccctgcagatgtgacaggccttccaatgcctaagattgaatggtccaaaaatgaaactgtaattgaaaaacccactgatgcacttcagataaccaaggaagaggtatcccgaagtgaggcaaaaactgagcttagcattcccaaagcggtccgggaggacaaaggcacttacacagttactgcttccaatcgccttggctcagtgttccgaaatgttcacgttgaagtatatgaccgcccatccccaccaagaaatcttgctgttactgacattaaagctgaatcttgctacttgacatgggatgcccctcttgataatggtggcagtgaaatcacccattatgttattgacaaacgtgatgcaagtaggaagaaagcagaatgggaggaagtcaccaacactgctgtagagaaaagatatgggatctggaaacttatccccaatggtcagtatgagttccgagtcagggcagtgaataaatatggaatcagtgatgagtgcaaatcagataaagtagtcattcaagatccttatcgccttcctggacctccaggaaaaccaaaagttttggcacgcaccaaaggatcaatgctagtgagctggactcctcctttggacaatggtggctctccaattactggctactggctggagaaaagagaagagggaagtccttattggtcacgtgttagccgagcaccaataaccaaagtgggattgaaaggcgtggaatttaatgttcctcgtttgcttgaaggcgttaaataccagttcagagccatggcaataaatgctgcaggaattggtcctcccagtgaaccatcagatccagaggttgcaggagatcccatatttccaccggggccaccttcttgcccagaagttaaagataaaacgaagtcaagcatctcactaggatggaaacctccagccaaagatggtggcagcccaatcaaaggatacattgtagaaatgcaagaagaaggtactactgactggaaaagagtaaatgaaccagacaaacttataactacctgtgaatgtgtggtgcctaatctgaaagagctcaggaagtacagattcagagtgaaagctgtcaatgaagctggtgaatctgaaccaagtgatacaactggggagatccctgccactgatattcaagaggaaccagaagttttcattgacattggagcacaggactgtctggtttgtaaagctggctcacagattaggattcctgctgtcatcaagggacgcccaacaccaaaatcatcttgggaatttgatggaaaggcaaagaaagcaatgaaggatggagttcatgacatacccgaagatgcacagctggagactgctgaaaactcctcagtaattattattccggagtgtaaacgatctcatacaggcaaatacagcatcacagccaagaataaagcaggacaaaagactgcaaattgcagagttaaagtcatggatgtaccaggcccacccaaagatctgaaagtcagtgatatcacaaggggtagttgcagactttcatggaagatgccagacgacgatggaggagacaggatcaaaggctatgttattgagaagaggactattgatggaaaagcctggaccaaagtcaatccagactgtggaagcaccacatttgtagtgcctgatctcctctctgaacagcaatatttcttccgtgtgcgagcagaaaaccgttttggtattggcccacctgtggaaaccattcagaggaccactgccagagatccgatatatcctcctgatcctcctattaaactcaagattggcctcatcacaaagaacacagtgcatctgtcatggaaacccccgaagaatgatgggggctcccctgttacccactatattgttgagtgccttgcatgggaccctactgggacaaagaaagaagcctggaggcagtgcaataagcgtgatgtggaagaactgcaatttactgttgaagacctagtagaaggtggggaatatgaattccgagtcaaagctgtcaatgctgcaggagtcagcaagccttcagccactgttggcccctgtgactgtcaaagaccagacatgccaccatcaattgatctaaaagaattcatggaggttgaagaaggaaccaatgttaacattgtggccaaaattaaaggtgtgccattcccgacactaacctggtttaaagctcctccaaagaagcctgataacaaagaacctgttctctatgacacccatgtcaacaaactggtggtagatgatacttgcactttagttattccgcagtctcgcaggagtgacactggcttatataccatcacagctgtaaataatctgggaacagcatcaaaggagatgagactgaatgtcctgggtcgtcctggccctccagtgggacccataaaatttgaatctgtttcagcagatcaaatgacactatcttggtttccacctaaagatgatggtgggtctaagattacaaactatgtaattgagaaaagagaagctaacaggaagacatgggtccatgtctccagtgaacctaaggagtgcacgtacacgattcccaaattgctagaaggccatgaatatgtattccgaatcatggcccagaataaatatggcattggagaacctcttgacagtgaacctgaaacagcaagaaacctcttctctgtccctggagcaccagataaaccaacagttagcagcgtgactcgtaactccatgactgtcaactgggaagagccagaatatgatggaggctctcctgtgacagggtactggctggaaatgaaagacaccacttcaaagagatggaagagagttaaccgagatcctatcaaagccatgactttgggtgtttcttataaagtgactggtcttattgaaggttccgactatcaattccgggtatatgcaatcaatgctgctggcgtgggtccagcaagtctgccatcagacccagcgactgctagagatccaattgcccctcctggtcctccatttcccaaagtgacagattggactaaatcatctgcagatctggagtggtctcccccactaaaagatggtggatccaaagtaactggatacatcgttgaatataaagaagaaggaaaagaagaatgggaaaagggtaaagataaagaagtgagaggaacaaagctcgttgtgacaggattaaaggaaggagcattctacaaatttagagttagtgcagtcaacattgctggcattggagaacctggagaggtcacagatgtcattgaaatgaaggacagacttgtttcacctgaccttcagctagatgccagtgtcagagatagaattgttgtccatgctggaggggtgatccgaatcattgcctatgtgtctggaaagcctcctccaaccgtcacctggaacatgaatgaaagaaccttacctcaagaagccaccattgagaccacagccattagctcatccatggtcatcaagaactgccagaggagccatcaaggcgtctattctcttcttgccaaaaatgaagccggagaaagaaagaagacaattattgttgatgtattagatgttccaggtcccgttggaacaccattcctagctcacaacctaaccaatgagtcctgcaaactgacatggttttctccagaagatgatggaggctctccaatcaccaattatgtcattgaaaagcgtgaatctgaccgcagagcatggaccccagtgacatatacagttacccgacaaaatgctactgtccagggtctcattcaaggaaaagcctactttttccgaattgcggctgaaaatagtattggcatgggtccatttgttgagacatcagaggcacttgttatcagagagccaataactgtaccagagcgtcctgaagacctggaagtcaaagaagttactaaaaatactgtaactttgacttggaatcctcctaagtatgatggtgggtcagaaattattaactatgtcctagaaagtcggctcattgggactgagaagttccacaaagttacaaatgacaacttgcttagcagaaaatacactgttaaaggcttaaaagaaggtgatacctatgagtaccgtgtcagtgctgtcaacattgttggacaaggcaaaccatcattttgcaccaaaccaattacttgcaaggatgagctggcacccccaacgcttcacctcgacttcagagataagctcacgattcgagttggtgaagcttttgccctcactggccgttactcaggcaaaccaaagcctaaggtttcctggttcaaagatgaagctgatgtgctggaagatgatcgcactcatataaagactacaccagcaacacttgctttagagaagatcaaggccaaacgttcagattccggcaaatactgtgtggttgtggagaacagtacaggctctaggaaaggtttctgtcaagttaatgttgttgaccatcctggaccaccagtaggaccagttagttttgatgaggtgaccaaagattacatggttatctcttggaagcctcctttagatgatggaggcagtaaaatcaccaattatattattgagaagaaggaagtgggtaaagacgtctggatgccagtgacatctgcaagtgctaaaacaacatgcaaagtttctaaactacttgaaggaaaagattatattttccggatacatgctgaaaatctgtatggaataagtgatcctctggtgtctgattcaatgaaagccaaagatcgtttcagggttcctgatgcacctgatcagccaattgttacagaagttaccaaagactctgcattagtaacctggaataagccacatgatggaggaaaacccatcacaaactacatcctggaaaagagagaaactatgtctaaacgatgggctagagttaccaaagatcctattcatccatacactaaatttagggttcctgatcttctagaaggatgtcagtatgaattccgggtttctgcagaaaatgaaattggtattggagatccaagcccaccatccaaaccagtctttgctaaagatccaattgctaaaccaagtccacctgttaatcctgaagcaatagatacaacatgcaattcagtcgatctaacttggcagccaccacgtcatgatggtgggagcaagattctgggttatattgttgagtaccagaaagttggagatgaagagtggagaagagccaatcacacccctgagtcatgtcctgaaactaaatataaagtcaccggtcttcgggacggtcaaacctataagtttagagtgttagcagtcaatgcagctggtgaatcagatccagctcatgttccggagccagtcctagtaaaagacaggcttgaaccccctgagttgattcttgatgccaacatggcaagagaacaacacattaaagttggtgatactctaagacttagtgccatcatcaaaggagtgccattcccaaaagtaacttggaaaaaagaagacagagatgctccaactaaagcaagaattgatgtgactccagttggtagcaagcttgaaattcgtaatgctgcccatgaagatggtggaatttattctttaacagtggagaatccagctggttcaaaaactgtctcagtaaaagtacttgtattagataaacctgggccacctagagatctggaagtcagtgaaattaggaaagattcatgttaccttacttggaaagaaccactagatgatggtggttctgttattaccaattatgtggttgagaggagagatgttgccagcgcccagtggtcacctctctcagctacatcaaagaaaaagagtcacttcgctaagcatctgaatgaaggcaaccagtacctcttccgagtagctgcggagaaccagtatggacgtggtccttttgttgaaacaccaaaaccaatcaaggctttggatcctctccatcccccagggccacccaaggacctgcaccatgtagatgttgacaagactgaagtctccctagtctggaataagccggatcgtgatggtggttctccaatcactggatatttggtagaatatcaagaagaaggcacccaggactggattaaatttaagactgtgacaaacttagagtgtgtggttactggactacaacaaggaaagacctatagattccgtgtaaaagctgaaaacattgtgggtcttggtctccctgacacaactatcccgatagaatgtcaagaaaaactagtgcctccatccgtggagctagatgtgaaattaattgaaggtcttgtggtaaaggctggaaccacagtcagattccctgctattataagaggtgtgcctgttcctactgcaaagtggacaaccgatgggagtgagattaaaaccgatgagcactacacagttgaaacagacaacttctcatcagtacttaccattaagaactgcttaaggagagacactggggaatatcaaatcacagtttccaatgcagccggtagcaaaacagtagccgtacatcttactgttcttgatgttcctgggccaccaacaggtcctattaatattctggatgttactcctgaacacatgactatctcatggcagccacctaaggatgatggaggaagccctgtgataaattatattgttgagaaacaagatacaaggaaagacacgtggggtgttgtctcttccggaagcagtaagacaaagctgaaaatcccacatctgcagaagggctgtgaatatgttttccgagttagagcagagaataagataggtgttggtcctccccttgactccacacctactgttgctaagcataaatttagtcctccgtctcctcctggtaaaccagtggttactgacattactgaaaatgcagcaacagtgtcttggaccctgccaaaatctgatggtggcagtccaataactggctactatatggaacgtcgagaagtaactggcaaatgggtgagggtcaacaaaacacctatcgctgacctgaagttcagagtgactggactctatgaaggaaatacatatgagtttagagtttttgctgaaaatcttgcaggactaagcaaaccatccccaagttctgatccaataaaagcttgccggcccatcaaaccacctggaccacctattaatcctaaactgaaagacaagagcagagaaacagctgatttggtgtggacaaagcctctcagtgatggtggtagccccattctaggatatgtagtggaatgtcagaaacctggcacggcacaatggaacaggattaataaagatgaactcattaggcaatgtgcctttagggtacctggactaattgaaggaaatgagtacagattccgtataaaggcagctaatattgtaggagagggtgagccaagagaactagcagaatctgtgattgcaaaagatatccttcatcctccagaagtagaacttgatgttacttgtcgtgatgttattaccgtgagagtaggccaaactatccgcattctagctcgagtcaaaggcagacctgaaccagacataacttggactaaggaaggcaaagtattggtccgagaaaagagggtggaccttattcaggatctacctcgtgttgagttacaaattaaagaagctgttagagctgatcatggcaagtatatcatctcagctaagaacagcagtggacatgcccaaggttcagccatcgttaacgtccttgacagacctgggccttgccagaatttgaaggttaccaatgtaaccaaagagaactgtacaatttcttgggaaaacccactagataatggtggctcagaaataacaaacttcatagtagaatatcgcaaaccaaaccagaaaggctggtcaattgttgcatcagatgtcactaaacgattaatcaaggccaaccttttagccaacaatgaatactatttccgagtttgtgcagagaataaagtaggtgttgggccaaccatcgaaacaaaaactcccattctggctattaaccctattgacagaccaggtgagcctgaaaaccttcacattgcagataaaggaaagacatttgtctacctaaagtggcggaggcctgactatgatggtggcagtccaaatctgtcatatcatgttgagagaaggcttaagggctccgatgactgggaaagagtgcataaaggaagcattaaagaaactcactacatggttgacagatgtgttgaaaaccagatttatgagttcagagtgcaaacaaagaatgaaggtggggaaagtgactgggtgaagacagaggaagttgttgtgaaagaagacttacaaaaaccagtacttgatctgaaattaagtggggtcctaactgtcaaagcaggggacaccattaggcttgaggcaggggttagaggcaaaccattcccagaagttgcatggaccaaggacaaagacgctacagacttaacaagatcaccaagggtcaagattgatacccgtgctgattcatctaaattttctcttactaaagcaaagcgaagtgatgggggtaaatatgtagttacggcaactaacacggctggcagttttgtggcctatgccactgtcaatgttttagataagcctggtcctgtgagaaatctgaaaattgttgatgtgtccagtgataggtgtactgtttgctgggatccaccagaagatgatggtggctgtgaaatccaaaattatattctagaaaaatgtgagacaaagcgaatggtttggtctacctattctgctactgtcttgacacctggtactacagtaacacgtctcatagaaggaaatgaatatattttcagagtccgtgcagaaaataaaataggcacagggcctccaacagaaagtaaaccagtcatagccaaaaccaagtatgataaacctggtcgccctgatcccccagaagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccatagagccacctggtccaccaaccaatttcagagtggttgatacaaccaaacattccataactcttgggtggggaaaaccagtctatgatggtggtgcaccgatcattggatatgttgtggaaatgagaccaaaaatagcagatgcgtctcctgatgaaggctggaaacggtgtaatgctgcagcacagcttgtacgcaaggaattcactgttaccagcttggatgaaaaccaggaatatgagttcagggtgtgtgcccaaaaccaagttggtattgggcgccctgcagagctaaaggaagctatcaaacctaaagaaatactagaacctccggagattgatttggatgccagcatgaggaaactggtcatagtgagagcaggatgccctattcgtctctttgctatagtgagaggacgaccagcccctaaagtcacttggcgaaaagttggcattgataatgtggtcagaaaaggacaagttgatctggttgacactatggccttccttgtcatccccaattctacccgtgatgactcaggaaaatattccttaacacttgtgaacccagcaggagaaaaggctgtattcgtaaatgtcagagtattagacactcctgggcctgtgtctgatttaaaagtttcagatgtcactaaaacatcatgccatgtgtcctgggcccctcctgaaaacgacggtgggagccaagtgacacattatatcgtggagaaacgtgaggcagacagaaagacatggtcgaccgttaccccagaagttaagaaaacaagcttccatgtaaccaatcttgtccctgggaatgagtattacttcagagtaactgctgtcaacgaatatggccctggcgtcccaacagatgtcccaaaaccagtgcttgcatcagatcctctaagtgagccggatcccccaaggaaattagaagcgactgaaatgaccaagaacagtgccaccttagcctggttacctcccctacgtgatggaggtgctaaaatcgatggctacatcattagttacagagaagaagagcagcctgcagatcgctggacagagtactcagtggtaaaagatctgagccttgttgtcactggcctaaaggaaggaaagaaatacaaatttagagtagcggccagaaatgctgttggagtcagtttgccaagagaagctgaaggagtgtatgaagccaaagagcaactgttgccaccaaagatccttatgccagagcaaataactatcaaagctgggaaaaaactccgaattgaagcccatgtgtatggaaagcctcatcccacctgtaaatggaaaaaaggagaagatgaagttgtcacatccagccacctggcagtgcataaagcagacagctcttcaattctgatcataaaagatgtgactaggaaagacagtggttactacagcctcacagcagagaacagttctgggacagacactcagaaaatcaaagttgtagtcatggatgcccccggcccccctcagcctccatttgacatttctgatatagacgctgatgcttgctccctgtcatggcacatccctctggaggacggaggcagtaacatcaccaattatatagtggagaagtgtgatgtaagccgaggtgactgggtcacggctctagcttcagtcacaaaaacttcctgcagggttggaaagctgatcccaggccaagagtacatcttccgggtccgtgctgaaaaccgatttggcatttcagagcctctcacatctccaaagatggttgcgcagttcccatttggtgttcctagtgaaccaaagaatgcacgagtcaccaaagtcaacaaggactgtatttttgttgcttgggacagaccagatagtgatggagggagccccattattggttatctgattgaacgcaaggaaagaaacagtttgctgtgggtgaaagccaatgatactcttgtccggtcaactgaatatccttgtgctggccttgtagaaggtcttgagtattcattcagaatctatgccctaaacaaagctggatccagcccacccagcaaacccacagaatatgtaactgcaagaatgccagttgatcctcctgggaaacctgaggttattgatgtcaccaagagtactgtatctctgatctgggctcgtccaaagcatgatggaggcagtaaaattattggctatttcgtagaagcttgcaaacttcctggtgataaatgggtacggtgcaatactgcacctcaccagattccccaggaagagtacacagctactggcctagaagagaaagctcagtatcaatttagagctattgccaggaccgcggtaaacattagcccaccttctgaaccttctgatccagtgactatcctcgcagaaaatgtccctcccaggatagacctgagtgtggctatgaaatctttgcttactgtgaaagctggaactaatgtctgcttggatgctactgtttttggtaaaccgatgccaacagtttcttggaaaaaagatggcacactgctaaaaccagcagaaggcataaagatggccatgcagcggaatctgtgcaccttggagctattcagcgtgaaccggaaggactcaggagactataccattactgctgaaaattcaagtggttctaaatcagccaccattaagcttaaagtgttagataaaccgggtcctccagcatctgttaaaatcaacaaaatgtattcagatcgtgctatgctttcttgggaaccgcctcttgaagatggaggctcagaaatcaccaactatattgttgacaaacgtgaaacaagcaggcccaactgggctcaagtctctgcaactgtgcctatcaccagctgcagcgtggagaaacttatagagggccatgagtatcagttccgtatttgtgctgaaaataaatatggagtaggcgatccagtcttcactgaaccagcaattgccaaaaacccatatgacccaccaggacgctgtgatcctcctgttattagcaacataaccaaagatcacatgacagtcagctggaagccaccagcagatgatgggggctcacccatcactggctatttgcttgaaaagcgggaaacccaggctgttaactggactaaggtcaacagaaaacctattatagaaagaacattaaaagcaacaggtcttcaagaaggtaccgaatatgagttccgtgttacagctataaataaagctggaccaggcaaacccagtgacgcatccaaggccgcttatgctcgggaccctcagtatcctcctgcgccaccggctttccctaaagtatatgatacaactcgcagctctgtgagtctatcttggggcaagccagcctatgacggcggcagccctatcattggttatctcgttgaagtaaaacgggctgactccgataactgggtgaggtgcaacttaccacagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacatgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgcttgatactcctgggccacctatcaatgtgactgttaaggaaatatccaaagactctgcttatgttacctgggagcctcccattattgatggcggaagccccatcataaactatgtggtacaaaaacgtgatgcagagaggaaatcctggtctacagtgacaactgagtgctccaaaacaagcttcagagtacctaatttggaggagggaaaatcctacttcttccgagtgtttgctgaaaatgagtatggcattggtgatcccggtgaaactcgtgatgctgtcaaagcttcccaaactcctggaccagttgtggacctgaaagtgaggtctgtatctaagtcatcctgtagcattggctggaaaaagcctcacagtgatggtggaagtcggattattggatatgtagttgatttcctgactgaagaaaataagtggcaacgagttatgaaatccttaagcctacagtactctgcaaaagatttgactgaagggaaggaatataccttcagagtgagtgctgagaatgaaaatggagaaggaaccccaagcgaaatcactgttgtggcaagggatgatgttgtggctcctgatcttgacttaaagggtctacctgatttgtgctacttggctaaagaaaacagcaacttccggcttaagatccccataaaaggcaagccagctccatcagtctcctggaagaaaggggaagatcctctagcaactgacactagagtcagtgttgagtcatctgcggttaacacaactcttatagtgtacgattgccaaaaatctgatgctggaaaatacacaatcacacttaagaatgttgctggcaccaaggaaggaactatctccataaaggttgttggcaagcctggcatccccactggaccaatcaaatttgatgaagtcacagcagaagccatgaccttaaagtgggctcctccaaaggatgatggaggttctgaaatcaccaactatatcctagagaagagggattctgtgaacaacaagtgggtgacgtgcgcctcagctgtccagaaaaccacctttagagtaaccagacttcatgagggcatggaatataccttcagggtcagtgccgaaaataaatatggtgtaggggaaggcctgaaatcggagccaattgttgcgagacatccatttgatgtgcctgatgctcccccacctcccaatattgtggatgtcagacacgattcagtatctctaacttggactgaccccaagaaaactggtggttctccaattacagggtatcatctcgagttcaaggaaagaaacagccttttgtggaagagagctaacaagactccgataaggatgagagactttaaagtgacaggattaactgaaggtcttgaatatgaattccgagttatggcaatcaatttagcaggtgtgggcaagccaagcctaccatcagagcctgttgtggcactggacccaattgatcctcctggaaaacctgaggttattaacataacaaggaattcagtgactctcatttggactgaacctaaatatgacggtggtcataagttaactggatatatagtggagaagcgagatctaccttcgaagtcttggatgaaagccaaccatgttaatgtcccagaatgtgcctttactgtaactgaccttgttgagggtggaaaatatgaattcagaattagagcaaagaatacagcaggtgctatcagtgctccatcagaaagtacagaaaccattatttgcaaggatgaatacgaggcaccaacaattgtccttgatcccacaataaaagatgggctaacaattaaagcaggggataccattgttttgaatgccattagcattcttggcaaaccccttccaaaatcaagttggtccaaggcaggaaaagacattagaccatcagatatcactcagataacttcaaccccaacatcttccatgcttactatcaagtatgccactagaaaagatgcgggtgaatataccatcactgctaccaatccttttggcacgaaggtggaacatgtgaaggtaacagtccttgatgtacctggtcccccaggtcctgttgaaatcagtaatgtttctgctgaaaaagcaacacttacatggacacctcccttggaagatggcggctcaccaattaagtcctatatacttgaaaagagagaaaccagccgacttttgtggacagtggtttctgaagatattcagtcttgcaggcatgtggcaaccaaacttatccaaggaaatgagtacatcttccgggtctcagctgtaaaccactatggcaaaggagaacctgtacagtctgaacctgtcaaaatggtagacagatttggtccccctggccctcctgaaaaaccagaggtatcaaatgtcactaagaacactgccactgtcagctggaaaaggccagtggatgatggtggcagcgaaattacaggatatcatgtagaaaggagagaaaagaaaagcctgcgatgggtgagagcaataaaaacaccagtttccgatctcaggtgcaaagtaacaggactgcaagaaggaagcacctacgaattccgtgtcagtgcagaaaacagagcaggaattggtccacccagtgaggcttcagattctgttctgatgaaagatgcagcatatcctccaggaccaccttcaaatccgcatgtcactgatactaccaagaaatctgcttctttggcatggggcaagcctcattatgatggtggacttgaaatcactggctatgtcgtggagcatcaaaaagtaggagacgaggcctggataaaagataccacaggaaccgccctcagaatcactcagttcgttgttcctgatcttcagactaaagaaaaatacaacttcagaatcagtgccatcaacgatgcaggtgttggggagccagcggtgattccagatgttgaaatcgtagaacgggagatggctcctgattttgaactagatgccgagcttcgaagaacacttgttgttagagcaggactcagtattaggatatttgtgccaattaaaggtcgtcctgctcctgaagtgacatggaccaaagataacatcaacctgaaaaaccgagccaacattgaaaatacggaatcatttactcttctgattatcccagaatgtaacagatatgataccggtaaatttgtcatgaccattgaaaacccggctgggaagaaaagtggctttgtgaacgtcagagtcttggacacgccaggcccagtcctcaacctgcggcctacagacatcacaaaggacagtgtcaccctgcactgggacctccctctgatagatggaggctcacgtataacaaactacattgtagagaaacgtgaagcaacacggaaatcttattccacagccaccactaagtgccataaatgcacatataaagttaccggcttgtctgaagggtgtgaatatttcttcagagtgatggcagagaatgaatatggaattggtgagccaacagaaactacagagcccgtaaaagcctctgaagcaccatctccaccagacagccttaacatcatggacataactaagagcaccgtcagcctggcatggcctaagcccaaacacgatggtggcagcaagatcactggctatgtgattgaagcccaaagaaaaggctctgaccagtggacccacatcacaaccgtgaaagggttagaatgtgttgtgaggaatctaactgaaggagaggaatataccttccaagtgatggcagtgaacagcgcggggagaagtgcccctagagaaagcagacccgtcattgtcaaggagcagacaatgcttccagagctggatctccgtggcatctatcagaaactggtcattgccaaagctggtgacaacatcaaagttgaaattccagtgctcggtcgaccgaagcccacagtgacatggaaaaaaggagaccaaattcttaaacagacacagagagttaattttgaaaccacagcgacttcaaccattttaaatatcaatgagtgtgtcagaagtgatagtgggccctatccattaacagcaaggaacattgtaggagaggttggtgatgtcatcaccattcaagtccatgatatcccagggccacctactggaccaatcaaatttgatgaagtttcatctgattttgtaaccttctcttgggacccacctgagaacgatggtggtgtaccaataagcaactatgtagtggaaatgcggcagactgacagtactacctgggttgagttagcaaccaccgttatacgtactacctataaagccacccgccttactactggattagagtatcagttccgtgtaaaagctcagaatagatatggagttggaccaggcatcacatcagcatggatagttgccaactatccatttaaggttcctggacctcctggtacccctcaggtaactgcagttaccaaggattcaatgacaattagctggcatgagccactttctgatggtggaagccccattttaggatatcatgttgaaagaaaagaacgaaatggtattctctggcagactgtgagcaaagctttagtaccaggcaacattttcaaatcaagtggacttacagatggtattgcttatgagttccgggtgattgcagaaaacatggcaggcaaaagtaagccaagcaagccatcagaacctatgttggctctggatcccattgacccacctggaaaaccagtacctctaaatattacaagacacacagtaacacttaaatgggctaagcctgaatatactgggggctttaaaattaccagttatatcgttgaaaagagagaccttcctaatggacggtggctgaaggccaacttcagcaacattttggagaatgaatttacagtcagtggcctaacagaagatgctgcatatgaattccgtgtgatcgccaaaaatgctgcaggtgccatcagtccaccatctgagccatctgatgctatcacttgcagggatgatgttgaggcaccaaagataaaggtggatgttaaatttaaggacacggttatattaaaagcaggtgaagcattcagactggaagctgatgtttcaggccgcccacctccaacaatggaatggagcaaagatggaaaagagctggaaggcacagcaaagttagaaataaaaattgcagatttctctactaatctggtaaacaaagattcaacaagaagggatagtggtgcctatacccttacagcgactaatcctggtggctttgctaaacacattttcaatgtcaaagttcttgacagaccaggcccacctgaaggacctttggctgtaactgaagtgacatcagaaaagtgtgtactatcatggttccctccactggatgatggaggtgccaaaattgatcattacatagtacagaaacgtgaaaccagcagattggcatggacaaatgtagcctcagaagtccaagtaacaaagctaaaggtcactaaactcttgaaaggcaatgaatacatattccgtgtcatggctgtaaataaatatggagtgggagagccactggaatcagagcctgtgcttgcagtgaatccttatggaccccctgatccgcccaaaaaccctgaagtgacaactattactaaagattcgatggttgtctgctggggacatcctgattctgatggtggaagtgaaatcatcaattatattgtggaacggcgtgataaagctggccaacgctggattaaatgcaacaaaaaaactcttactgatttaagatataaagtgtctggactgacagaaggacatgaatatgagttcaggattatggctgaaaatgctgctggaattagtgcaccaagtcctaccagtccattttacaaggcttgtgacactgtgtttaaacctggaccaccaggtaacccacgtgttctggatacaagcagatcatccatttcaatcgcttggaataaacctatctatgatggtggttcagaaatcactgggtatatggttgagattgccctgccagaggaagatgaatggcagattgtcactccaccagcaggactcaaggcaacttcgtatactatcactggcctcacagagaatcaggaatataagatccgcatctatgccatgaattccgaaggacttggggaacctgcccttgttcctggaactccaaaggctgaagacagaatgctgcctccagaaattgaactggatgctgacctgcgcaaagttgttactataagggcctgctgcaccctgagactttttgttcccatcaaaggaaggcctgaccctgaggtgaagtgggcccgggaccatggagaatctttagataaagctagcatcgaatccgcaagctcttacaccctgcttattgttggaaatgtaaacagatttgacagtggcaaatatatactaactgtagaaaatagttcaggcagcaagtctgcatttgtcaatgttagagttctcgatacaccaggccccccacaggatctgaaggtaaaagaggtcactaagacatctgtcacactcacatgggacccacctctccttgatggaggttcaaaaatcaagaactatattgttgaaaagcgggaatcaacaagaaaagcatattcaactgttgcaacaaactgccacaagacttcctggaaggtagaccagcttcaagaaggctgtagctactatttcagggttctcgcagaaaatgaatatggcattgggctgcctgctgaaaccgcagaatctgtgaaagcatcagaacgacctcttcctccaggaaaaataactttgatggatgtcacaagaaatagtgtgtcactctcttgggagaaaccagagcatgatggaggcagccgaattctaggctacattgtggagatgcagaccaaaggcagtgacaaatgggccacgtgtgccacagtcaaggtcactgaagccactatcactggattaattcagggtgaagaatactctttccgtgtttcagctcagaatgaaaagggcatcagtgatcctagacaactgagtgtgccagtgatcgccaaagatcttgtcattccaccagccttcaaactcctgttcaatactttcactgtactggcaggtgaagacctaaaagttgatgttccattcattggccgccctaccccagctgtaacctggcataaagataatgtaccactgaagcagacaactagagtaaatgcagagagcacagaaaataattcactactgacaataaaggacgcctgccgagaagatgttggccattatgtggttaaactgactaactcagctggtgaagctattgaaacccttaatgttatcgttcttgacaaaccagggcctccaactggaccagttaaaatggatgaagtgacagctgatagtattactctttcctggggcccacccaagtatgatggcggaagttctatcaataattacattgttgagaaacgggacacttccacaaccacctggcaaattgtatcagctacagttgcaaggacaacaataaaggcttgcagactgaagactggatgtgaatatcagtttagaattgcagctgaaaacagatatgggaagagtacctacctcaattcagagcctactgtagcccaatatccattcaaagttcctggtcctcctggcactccagttgtcacactgtcctccagggacagcatggaagtacaatggaatgagccaatcagtgatggaggaagtagagtcattggctatcatctagaacgcaaggaaagaaatagcatcctctgggttaagttgaataaaacacctattcctcaaaccaagtttaagacaactggccttgaagaaggtgttgaatatgaatttagagtctctgcagagaacatcgtgggcattggcaagccgagtaaagtatcagaatgttatgtggctcgtgacccatgtgatccaccaggacggccagaggcaatcattgtcacaaggaattctgtgactcttcagtggaagaaacccacctatgacggtggaagcaagatcactggttatattgttgagaagaaagaattacctgagggccgttggatgaaagccagttttacaaatattattgacactcattttgaagtaactggcctagttgaagatcacagatatgagttccgggttatagcccgaaatgccgcaggagtgtttagtgagccttcagaaagcacaggagcaataacagctagagatgaggtagatccaccacgaataagtatggatccaaaatacaaagacacaatcgtggttcatgctggtgaatcattcaaggttgatgcagatatttatggcaaaccaataccaaccattcagtggataaaaggtgatcaggagctttcaaacacagctcgattagaaataaagagcaccgactttgccaccagtctcagtgtaaaagatgcagtacgtgtcgacagtggaaattacatactgaaggccaaaaatgttgcaggagaaagatcagttactgtgaatgtcaaggttcttgacagaccagggccacctgaaggacctgttgttatctcaggagttacagcagaaaaatgcacactagcttggaaacccccacttcaggatggtgggagtgacatcataaattatattgtggaaaggagagaaaccagccgcttagtttggactgtggttgatgccaatgtgcagactctcagctgcaaggttactaagcttcttgaaggcaatgaatatactttccgtataatggcagtaaacaaatatggtgttggtgaacctcttgaatctgagccagtagttgccaagaatccatttgtagtaccagatgcaccaaaagctccagaagtcacaacagtgaccaaggactcaatgattgttgtatgggaaagaccagcatctgatggtggtagtgaaattcttggatatgttcttgagaaacgggataaagaaggcattagatggacaagatgccataagcgtctgattggagagttgcgcctgagagtaactggactcatagaaaatcacgattatgagttcagagtttctgctgagaatgctgctggacttagtgaaccaagccctccttctgcttaccaaaaggcttgtgatcctatttataaaccaggacccccaaacaaccccaaagtcatagacataaccagatcttcagtattcctttcttggagcaaaccaatatatgatggtggctgtgaaattcaaggatacattgttgaaaaatgtgatgtgaatgttggtgaatggacaatgtgcactccaccaacaggaattaataaaacaaacatagaagtagagaagctgttggaaaagcatgaatacaacttccgtatctgtgctattaataaagctggagttggagaacatgctgacgtccctggacctattatagttgaagaaaaattagaagcaccagacattgatcttgacctagaactaaggaaaatcataaatataagggcaggtggctccttaaggttatttgttcctataaaaggtcgtcctacaccagaagttaaatggggaaaggtggatggtgaaatccgagatgcagctataattgatgtcactagcagtttcacctctcttgttcttgacaatgtcaaccgatatgatagtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatggaagtgccaatttctggacgtcctaagccaaccattacctggactaaagatggtctcccactgaagcagaccacaagaatcaatgttaccgattcactggatctcaccacactcagtattaaagaaactcataaggatgatggtggacaatatggaatcacagttgccaatgttgttggtcagaagacagcatccatcgaaattgtaactctagataaacctgatcctccaaaaggacctgttaaatttgatgacgtcagtgctgaaagtattacattatcttggaaccctccattatatacagggggctgccaaatcaccaactacattgttcagaaaagagatacaaccaccacagtatgggatgttgtttctgctactgttgctagaactacactcaaagtgaccaaactgaaaactggtacagaataccaatttagaatatttgccgaaaacagatatggacaaagctttgccttagagtctgatccaattgtagctcaatatccctacaaagaaccaggccctccaggtacaccatttgccacagccatttccaaagactccatggtcatacagtggcatgaaccagtcaacaatggtggaagccccgtcataggttaccacctggagagaaaagaaagaaacagtattttgtggacaaaggtcaacaaaactattattcatgacacccaattcaaagcacagaatcttgaagaaggcattgaatatgaattcagagtgtatgctgaaaatattgttggtgtaggcaaagcaagcaagaattctgaatgctatgtagccagagatccctgtgacccaccaggaaccccagaaccaataatggttaaaagaaatgaaatcactttacagtggaccaaacctgtgtatgatggtggaagtatgattacaggctacattgtagagaaacgtgatttgcctgatggtcgttggatgaaagctagctttacaaatgtcattgaaactcaatttactgtgtcaggtcttactgaagatcaaagatatgaattcagagtcattgcaaagaatgcagctggtgcaataagtaaaccctctgacagtactggaccaataactgccaaggatgaggttgaactcccaagaatttcaatggatccaaaattcagagacacaattgtggtaaatgctggagaaacattcagacttgaggctgatgtccatggaaagcccctacctaccattgagtggttaagaggagataaggaaattgaagaatctgctagatgtgaaataaagaacacagatttcaaggctttacttattgtaaaagatgcaattagaattgatggtgggcagtatattttaagagcttccaatgttgcaggttctaagtcattcccagtaaatgtaaaagtattagatagaccaggacctccagaagggccagtccaggttactggagtcacttctgaaaaatgctctttaacatggtctccaccacttcaagatggtggcagtgacatttctcactatgttgttgaaaagcgagaaaccagtcgacttgcctggactgttgttgcttcagaagttgtgaccaattctctgaaagttaccaaactcttagaaggtaatgaatatgttttccgtataatggctgtcaacaaatatggtgttggagagcctttggaatctgcaccagtactaatgaaaaatccatttgtgcttcctggaccaccaaaaagcttggaagtcacaaatattgccaaagactccatgaccgtctgttggaaccgtccagatagtgatggtggaagtgagattattggttacattgtagagaaaagagacagaagtggcattcgatggataaaatgtaataaacgccgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaatgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaatttggagttggtgttccagtggaaactgttgatgccgtgaaagctgctgaacctccttccccaccaggaaaggttacactcactgatgtgtcccagaccagtgcatcacttatgtgggagaaacctgaacatgatggcggtagcagagtcctggggtacgttgttgaaatgcagcccaaaggaactgaaaaatggagcattgtggctgaatccaaagtctgtaatgcagttgttactggtttgagttctggacaagaatatcagttccgtgtcaaggcttataatgagaaaggaaaaagcgatccaagagtgttgggtgttcctgtcatagccaaggacttgactatacagcctagtttaaagttaccatttaacacatatagtatccaagctggagaagatcttaaaatagaaattccagttataggccgaccaagacctaacatttcttgggtcaaagatggtgagcctcttaaacagacaacaagagtaaacgttgaagaaacagctacctcaactgttttgcacattaaagaaggtaacaaagatgactttggaaaatacaccgtaacggcaacaaatagtgcaggcacagcaacagaaaatctcagtgttatcgttttagaaaagcctggacctccagttggcccagttcggtttgatgaagttagtgcagactttgtagtcatatcttgggaacctccagcctatactggtggctgccaaataagcaactacattgtagagaagcgagatacaaccaccaccacttggcacatggtatcagcaacagttgcaagaacaacaattaaaataaccaaactgaaaacaggcacggagtaccagtttagaatttttgctgaaaacaggtatggaaaaagtgccccactggattctaaggcagttattgtacaatatccatttaaagaacctggaccacctggaactccttttgtgacatcaatctcaaaagatcagatgcttgtgcaatggcatgagccagtgaatgatggaggcaccaaaattattggctaccatcttgaacagaaagaaaagaacagtattttatgggtcaagttaaataagacccccattcaggacaccaaattcaaaacaactgggcttgatgagggccttgagtatgagttcaaagtttctgctgaaaatattgttggcattggcaagcctagcaaagtgtcagaatgctttgttgctcgtgatccatgtgacccacctggtcgccctgaagccattgttattacaagaaacaatgtcacactgaaatggaagaaacctgcctatgatggtggtagcaaaataacaggttatattgtagaaaagaaagatctacctgatggccgctggatgaaagccagctttaccaacgtattagaaactgaatttacagtgagtggacttgtagaagaccaaagatatgaatttagagtaattgcaagaaatgcagctggaaactttagtgaaccatctgatagtagtggtgccattactgcaagagatgaaattgatgcaccaaatgcctctctggatccaaaatataaagatgtcatcgttgttcatgcaggagagacttttgttcttgaagccgacatccgtggcaaacctatacctgatgttgtttggtcaaaagatggaaaagaacttgaagaaacagctgctagaatggaaattaaatctactattcagaaaacaactcttgttgtcaaagactgtatacggactgatggaggacaatatattctgaaactcagcaatgttggtggtacaaagtctatacccatcactgtaaaggtacttgacaggccagggtctcctgaagggcctctgaaagttactggagttactgcggaaaaatgttacctggcatggaacccacctttgcaagatggtggtgctaatatttcacattacatcattgaaaagagggagacaagccgactctcttggacccaggtttcaactgaggtacaggcccttaactacaaagttactaaacttcttcctggtaatgagtacattttccgtgtcatggctgtgaataaatatggaattggagagcccttggaatctgggcctgttacggcctgtaatccttataagccaccaggtcctccctcaacacctgaagtctcagcaatcaccaaagattctatggtagtaacatgggcacgcccagtagacgacggaggtaccgaaattgagggctacattcttgaaaaacgagataaggaaggcgttagatggaccaagtgcaacaagaaaacattaacggatctgcggctcagggtaactggtcttaccgaaggccattcctatgaattcagagttgctgctgaaaatgcagctggtgtgggagaacctagtgagccatctgttttctaccgtgcgtgtgatgccttgtatccaccaggtcccccaagcaatccaaaagtgacggacacttccagatcttctgtctccctggcatggagtaagccaatttatgatggtggcgcacctgttaaaggctatgttgtagaggtcaaagaagctgctgcggatgaatggacaacctgcactccaccaacaggattacaaggaaagcagttcacagtgaccaagcttaaagaaaacactgaatataacttccgtatttgtgccatcaattctgaaggtgtaggtgaacctgcaactctacctggctcagtggttgctcaggagaggatagagccaccagaaatagaactcgatgctgatctcagaaaggtggtcgttctgcgtgcaagtgctactttacgcttatttgtcactatcaaaggtcgaccagaacccgaagttaaatgggaaaaggcagaaggcattctcactgacagggctcagatagaggtgaccagctcatttacaatgttggtgattgataatgttaccagatttgacagtggtcggtataatctgacattagaaaataatagtggctccaaaacagcttttgttaacgtcagagttcttgactcaccaagtgcccctgtgaatttgaccataagagaagtgaagaaagactcagtgacgttgtcctgggaaccaccacttattgatggtggagctaagattacaaactacattgtcgaaaaacgagaaactacaagaaaagcctatgctaccattacaaataattgcactaaaactactttcagaattgaaaatctacaagaaggatgttcttactacttccgagtcttggcttccaatgaatatgggattggtttgccagctgaaacaacagaacccgttaaagtgtctgaaccacccctcccacctggaagagtaactcttgttgatgtgacccgtaatacagctacaattaagtgggagaaaccagaaagtgatggtggcagcaaaattactggttatgtggttgaaatgcagactaaagggagtgaaaagtggagcacctgcacacaagttaagactctagaagcaactatatctggcttaactgcaggagaagagtatgtcttcagggtagctgcagttaacgaaaagggaagaagtgatccaagacaacttggagtgccagtaattgcaagggatattgaaataaagccttcagttgagcttcctttccatactttcaatgtaaaggctagagaacaacttaagattgatgtgccattcaaaggaagacctcaagctactgtgaactggagaaaagatggtcagactcttaaagagacaactagagtcaatgtttcttcttcaaagactgtaacatcactatctattaaggaagcttcaaaggaagatgttggaacttatgaattatgtgtttcaaacagtgctggatccataacagttcctattactataattgtccttgacagaccaggacctccaggtcctatacgtattgatgaggttagttgtgacagcataaccatttcttggaatcctccagaatatgatggtggctgccaaattagcaattacattgttgaaaagaaagaaaccacctctacaacatggcacatagtttcacaagcagttgcaagaacatccattaaaatagttcgcctgacaacaggaagtgagtatcagttccgtgtttgtgcagaaaaccgctatggaaagagctcctacagtgaatcttcagctgttgttgcagagtatccattcagtcccccaggtcctcctggtactcctaaagttgtgcatgccacaaaatctaccatgcttgtaacctggcaagtgccagttaatgatggaggaagtcgagtaattggctatcatcttgagtataaagaaagaagcagcattctttggtcaaaagcaaataaaatcctcattgctgatactcaagtgaaagtctccggccttgatgaaggactgatgtatgagtatcgtgtatatgctgaaaatattgctggaattggtaaatgcagtaaatcttgtgaaccagtccctgcaagagatccttgtgaccctcctggacaacctgaagtcacaaatatcacaagaaaatcagtgtcacttaaatggtctaaaccacattatgatggtggagctaagatcacaggatacattgttgaacgcagagaactaccagatggccggtggctaaagtgcaattatactaatatacaagaaacatactttgaagtaactgaacttactgaagatcagcgttatgaattccgggtttttgcaaggaatgctgctgactcagttagtgagccatctgaatccactgggcctattatagttaaagatgatgttgagcctccaagagttatgatggatgtcaagttccgagacgttattgttgtcaaagctggagaggtccttaagataaatgcagacattgcagggcgacctctgccagtaatttcctgggccaaggatggtatagaaattgaagaaagagcaagaacagaaatcatctcaacagacaatcatactttgttaacagttaaagactgtataagacgagacactgggcaatatgtactaacactgaagaatgttgccggcactcggtctgtggccgttaattgcaaagtacttgataagcctggtccaccagcaggaccacttgaaataaatggcctcactgctgagaaatgctctctttcctggggacgtccccaagaagatggtggtgcagatatcgactattaccatcgtaaaaaacgtgaaacaagccaccttgcatggacaatatgtgaaggagagttacagatgacatcctgtaaagtaaccaagttactcaaaggcaatgaatatatatttagagtaactggtgttaataaatatggtgttggtgagcccctagagagtgtagctataaaggcactagatccatttacagttccaagtccacccacgtctttggaaattacttctgtgaccaaagaatctatgacactttgctggtcaagacccgagagtgatggaggtagtgaaatatctggatatataattgaaaggcgagagaaaaatagcctaagatgggtgcgtgtaaacaaaaaaccagtttatgatctaagagtgaaatcaacaggacttcgggaaggatgtgaatatgaatatcgtgtttatgcagaaaatgctgctggcctaagtcttccaagtgaaacctctcccttaattagggcagaagatccagtgttcctaccatctcctccatccaaacccaaaattgtggactcaggcaagacaactataactattgcctgggttaagccgctgtttgatggtggggccccgataactggatatactgtagaatacaaaaaatctgatgacactgactggaaaacttccattcagagcttacgagggacagaatatacaataagcggactaacaacaggagctgaatatgttttcagagtaaaatctgtcaataaggttggtgctagtgaccccagtgatagctctgaccctcagatagcaaaggaaagagaagaagaacctttatttgatattgacagtgaaatgaggaagaccttgattgtcaaggctggtgcctcatttaccatgactgtgcctttccgaggaagaccagtacccaatgtcttgtggagtaagccagacactgacctccgtactagagcttatgttgataccacagactctcgtacatcactgaccattgaaaatgccaacagaaatgactctggaaagtacacattaacaattcagaatgttttgagtgctgcttcactgaccttagttgtcaaagttttagataccccaggtcctccaaccaacattactgtgcaagatgtaaccaaagagtctgcagtgttatcctgggatgttcctgaaaacgatggtggagcaccagtgaagaattaccacatagaaaaacgtgaggccagcaagaaagcatgggtctctgtgaccaacaactgtaaccgcctctcctacaaagttaccaatttacaagaaggagctatctattacttcagagtctctggagaaaatgagtttggtgttggtataccagctgaaacaaaggaaggagtaaaaataacagaaaaaccaagcccacctgaaaaacttggagtaacaagtatatccaaagacagtgtttccctgacctggctgaagcctgaacatgatggcggaagcagaattgtacactatgtcgttgaagcactagaaaaaggacagaaaaactgggttaaatgtgcagtggcaaagtcaacccatcacgttgtttccggtctgagagagaattctgaatactttttccgagtgtttgctgaaaatcaagctggcctgagtgacccgagagagcttctgcttcctgttcttattaaggagcaactagaaccacctgaaattgatatgaagaatttcccaagtcacactgtatatgttagagctggttcaaaccttaaagttgacattccaatctctggaaaaccacttcccaaagtgaccttatcaagagatggtgtcccccttaaggcaaccatgagatttaataccgaaattactgctgagaacctgaccatcaatctcaaagaaagtgttacagctgacgctgggagatatgaaatcactgctgccaactccagtggtacaaccaaagctttcattaacattgttgtgctagacaggcctggtcctccaactggccctgttgttattagtgatataactgaagaaagtgtgactctcaaatgggagccacctaagtatgacggtggaagtcaagttaccaactacattctactcaaaagagaaacaagtactgcagtgtggactgaagtgtctgcaacagttgcaagaaccatgatgaaagtcatgaaactgaccacaggagaagaataccaattccgcatcaaggcagaaaaccgctttggcatcagtgatcatatagattcagcttgtgtgactgtcaaactaccatacacaacacctggaccaccatctacaccatgggtcactaatgttactcgagaaagcatcactgtgggctggcatgaaccagtgtcaaatggaggcagtgcagtcgtaggctatcacctggaaatgaaagacagaaacagtattttatggcaaaaagccaacaaactggtcatccgcacaactcacttcaaagtcacaacaatcagtgctggacttatttatgaattcagggtgtatgcagaaaatgctgctggagttggaaaacctagccatccttctgaaccagtcttggcaattgatgcttgtgaacccccaagaaatgttcgtatcactgatatttcaaagaactctgtcagcctttcatggcaacaaccagctttcgatggaggtagcaagattacaggctacattgttgagagacgtgaccttccagatggcagatggaccaaggccagcttcaccaatgttactgaaactcaattcaccatctctggcttgactcagaattcccagtatgaattccgtgtctttgctaggaatgctgttggttccattagcaatccatctgaggttgtagggcccattacttgcatcgattcttatggtggtcctgtaattgatttgcctctagaatatacagaagttgtcaaatacagagcaggtacatctgtgaagctcagagctggcatttctggcaaacctgcgcctactattgagtggtataaagatgataaagaattacaaaccaatgcactggtgtgtgttgaaaataccacggacctcgcatctatactcatcaaagatgccgatcgccttaatagtggatgctatgaattaaaactaaggaatgccatggcgtcagcctcagccaccatcagagtacagatccttgacaaaccaggcccacctggtggaccaattgaatttaagactgtaactgctgagaagatcacccttctctggcggcctccagctgatgatggtggtgcaaaaatcactcactacattgtggaaaagcgtgagacaagccgcgttgtgtggtctatggtgtctgaacatttggaagagtgcatcattacaaccaccaaaattatcaaaggaaatgaatacatcttccgggtccgagccgtgaacaaatatggaattggcgagccactggaatctgattccgttgtagccaagaacgcatttgttacacctgggccaccaggcataccagaagtgacaaagattaccaagaattcgatgactgttgtatggagcaggccaattgcagatggcggtagtgatataagtggctatttccttgaaaaacgagacaagaagagcctaggatggtttaaagtactaaaagagactatccgtgacaccagacaaaaagtaacaggactcacagaaaacagtgactatcaatacagagtttgtgctgtaaacgctgctggacagggtccattttctgaaccatctgaattctacaaagctgctgatcctattgatcctccaggtccacctgctaagataagaatcgcagattcaaccaagtcatccatcacccttggctggagtaagcctgtctatgatgggggcagtgctgttactgggtatgttgtcgagataagacaaggagaggaagaggaatggactactgtctctaccaaaggagaggtcagaactacagaatatgtggtatccaacctgaaacctggagtcaattactacttccgggtatctgctgtaaactgtgctggacaaggagaacctatagaaatgaatgaacctgtacaagctaaagatatacttgaggcaccagagattgacctggatgtggctctcagaacttctgttattgccaaagctggtgaagatgtacaagtgttgattccctttaaaggcagacctccacctactgtcacatggagaaaagatgagaagaatcttggcagtgatgccagatacagcattgaaaacactgattcatcctcattactcaccattcctcaagttactcgcaatgatacaggaaaatatattctcacaatagaaaatggagttggtgaacctaagtcttcaactgtgagtgttaaagtgcttgacacaccagctgcctgccagaaactacaggttaaacatgtttctcgaggcacagtcactttgctctgggatcctcctctcattgatggaggatctccaataattaattatgtcattgaaaagagagatgccaccaagagaacatggtctgtcgtgtcacacaaatgttctagcacatccttcaagctaatagatttgtcggagaagactccattcttcttcagagttcttgcagaaaatgaaattggaattggggaaccctgtgaaactacagagccagtgaaggctgctgaagtaccagctcctatacgtgatctctcaatgaaagactcaacaaagacatctgtcatcctcagctggaccaaacctgactttgatggtggtagcgtcatcacagaatatgttgtagaaaggaaaggtaaaggtgaacagacgtggtcccacgctggcataagtaagacatgtgaaattgaggttagccaacttaaggagcagtcagtcctggagttcagagtgtttgccaaaaatgagaaaggactgagtgatcctgtcactattgggccaattacagtgaaagaacttattattacacctgaagttgacctgtcagatatccctggggcacaagtcactgtgagaattgggcacaatgtgcaccttgaattaccttataagggaaaacccaaaccatccatcagttggctgaaagatggcttgccactgaaagaaagtgaatttgttcgcttcagtaaaactgaaaacaaaattactttgagtattaagaatgccaagaaggagcatggaggaaaatacactgttattcttgataatgcagtgtgtagaattgcagtccccattacagtcatcacccttggcccaccatcaaagcccaaaggacccattcgatttgatgaaatcaaggctgatagtgtcatcctgtcatgggatgtacctgaagataatggaggaggagaaattacttgttacagcatcgagaagcgggaaacttcacaaactaactggaagatggtgtgttcaagtgttgccagaacgactttcaaagttcctaatctagtcaaagatgctgaataccagtttagagtgagagcagaaaacagatacggagtcagccaaccacttgtctcaagcattattgtggcaaaacaccagttcaggattcctggtcccccaggaaagccagttatatacaatgtgacttctgatggcatgtcactaacttgggatgctccagtttatgatggtggttcagaagttactggattccatgttgaaaagaaagaaagaaatagcatcctctggcaaaaagttaatacatcaccaatctctggaagagaatatagagccactggactggtagaaggtctggattaccaattccgtgtatatgctgaaaattctgctggcctaagctcacctagtgacccaagcaaatttaccttagctgtttctccagtagacccacctggcactcctgactacattgatgtcacccgggaaaccatcacacttaaatggaacccaccattgcgtgatggaggcagtaagattgtgggctatagcattgagaaacggcaaggaaatgaacgctgggtgagatgcaactttactgacgtcagtgaatgtcagtacacagttacaggactcagtcctggggatcgctatgagttcagaataattgcaagaaatgctgttggaactataagcccgccctcacagtcttctggcattattatgacaagagatgaaaatgttccaccaatagtagagtttggccctgaatactttgatggtctcattattaagtccggagagagccttagaattaaagctttggtacaaggaagaccagtgcctcgagtaacttggttcaaagatggagtggaaatcgaaaagaggatgaatatggaaataaccaacgtacttggatccaccagcctatttgttagagatgctactcgggaccatcgtggtgtatacacagtggaagccaaaaatgcatctggttctgcaaaagcagaaattaaagtgaaagtacaagatacaccaggaaaagtagttgggccaataagattcaccaatattactggggagaagatgactctgtggtgggatgccccactcaatgacggttgtgctcccataacccactacatcattgaaaaacgggaaaccagcagacttgcctgggcactaattgaggataaatgtgaagcccaaagttacactgccattaaactaataaacggcaatgaataccaattccgtgtttctgcagttaacaagtttggtgttggcaggccacttgattctgatccagtggttgctcaaatacaatatactgttcctgatgcccctggcattccagaacctagcaacataacaggcaacagcattaccctgacatgggcaaggccagaatcagatggtggcagtgaaattcaacagtatatccttgaaagaagagaaaagaaaagcacaagatgggtaaaagtgatcagcaaacgaccaatctctgaaacaagattcaaagtcactggtctgacagaaggcaatgagtatgaattccatgtcatggctgaaaatgctgcaggagttggacctgcaagtggcatctcaagactcattaaatgtagagagcccgtcaacccaccaggtcctcccacagtggtcaaagtaacagacacatcaaagacaactgtgagcttagaatggtccaaaccagtgtttgatggtggcatggaaataattgggtatattattgaaatgtgtaagaccgacttaggagactggcacaaggtgaatgcagaggcatgtgtgaaaacaagatatacagtcactgatctacaagcaggtgaagaatacaaattccgagttagtgctatcaatggtgctggaaaaggcgacagctgtgaagtgactggcacaattaaagcagttgaccggttaacagctcctgagttagacatagatgcaaacttcaaacagactcatgttgttagagctggggccagtattcgcctcttcattgcctaccaaggtagacctactcctacagctgtgtggagcaaaccagactctaaccttagccttcgggctgatatccatacaacagattccttcagcaccctcactgtggaaaactgcaacagaaatgatgcagggaaatatacccttactgtggaaaacaacagtggtagtaagtcaatcacattcaccgtgaaagtgctagacactccaggcccacctggcccaattaccttcaaagatgtgacccggggatctgctacattgatgtgggatgcccctcttcttgacggtggtgcccgaatccatcattatgtggtagagaaacgagaggcaagtcgccgtagttggcaggttatcagtgaaaaatgcactcgtcagatcttcaaggtcaatgacctggccgaaggtgttccgtactatttccgtgtttctgcagtaaatgagtatggtgttggtgagccctatgaaatgccagaaccaattgtagccacggaacagcctgctccacctaggagacttgatgttgttgatactagcaaatcctccgcagtcttagcttggcttaaacctgaccacgatggaggcagccggatcactggctacctgcttgaaatgagacaaaagggatctgacctctgggttgaagctggtcacaccaaacagctaactttcacagtagagcgtcttgttgagaaaactgaatatgaattccgtgtgaaggccaagaatgatgctggctatagtgaacccagagaagccttctcttctgtcatcattaaggagcctcaaatcgagcccactgctgacctcactggaattaccaatcagcttataacttgcaaagcaggaagcccatttaccattgacgtaccaatcagtggtcgtcctgcccccaaagtaacatggaaactggaagaaatgagacttaaagagacagatcgagtgagcattacaacaacaaaagacagaaccacactgactgtaaaggacagcatgagaggtgactctggaagatacttcttgaccctggaaaatacagctggtgttaaaacatttagcgtcacagttgtggtcattggaaggccaggtccagtaaccggccccattgaggtctcatctgtctcagctgaatcgtgtgtcctgtcatggggagaacctaaagatggaggaggcactgaaattactaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccagaggtgacagatgtcacaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaaggagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaacgttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccaatcaacaattacatcgttgagaagcgtgaagctgctatgagagcattcaaaacagtaactaccaaatgcagcaagacactttacagaatttctggacttgtagaaggaaccatgcactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactacttcagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaaggaaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaaggtggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgcctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggtgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaaaacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaagttaaatggtaccacaatggtgtggaactccaagaaagcagtaagattcattacaccaacacgagtggagttctcaccctggaaattctggactgtcatactgatgacagtggaacctaccgtgctgtgtgcaccaactacaagggcgaagcttctgactatgcaacgttggacgtgacaggaggggattataccacctatgcttcccaacgcagagatgaagaggtccccagatctgttttccctgagctgacaagaacagaggcgtatgctgttccatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcggcaagaattctaacaaagccacggtccatgaccgtctacgagggcgagtctgcaaggttttcttgtgacaccgatggtgagccggtaccaactgtgacctggctgcgtaaaggacaagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaagagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgccttatactctacactcattcttaacttttcgcaaacgtttcacacggactaatctttctgaactgtaaatatttaaagaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaaaaaaaa

SEQ ID NO: 1093 - DNA, 511 bp, Homo sapiens
  Genbank Accession No. X93036
  unsure (1)..(511): n = a or c or g or t
cccgatttctcccggaacctctgctcagcctggtgaaccacacaggccagcgctctgacatgcagaaggtgaccctgggcctgcttgtgttcctggcaggctttcctgtcctggacgccaatgacctagaagataaaaacagtcctttctactatgactggcacagcctccaggttggcgggctcatctgcgctggggttctgtgcgccatgggcatcatcatcgtcatgagtgcaaaatgcaaatgcaagtttggccagaagtccggtcaccatccaggggagactccacctctcatcaccccaggctcagcccaaagctgatgaggacagaccagctgaaattgggtggaggaccgttctctgtccccaggtcctgtctctgcacagaaacttgaactccaggatggaattcttcctcctctgctgggactcctttgcatggcagggcctcatctcacctctcgcaagagggtctctttgttcaattttttttaatctaaaatgattan

SEQ ID NO: 1094 - DNA, 1130 bp, Homo sapiens
  Genbank Accession No. X93510
tgagagtccggctcaggctccggctgcggctccagcccgcgatgccccattccgtgaccctgcgcgggccttcgccctggggcttccgcctggtgggccgggacttcagcgcgcccctcaccatctcacgggtccatgctggcagcaaggcctcattggctgccctgtgcccaggagacctgatccaggccatcaatggtgagagcacagagctcatgacacacctggaggcacagaaccgcatcaagggctgccacgatcacctcacactgtctgtgagcaggcctgagggcaggagctggcccagtgcccctgatgacagcaaggctcaggcacacaggatccacatcgatcctgagatccaggacggcagcccaacaaccagcaggcggccctcaggcaccgggactgggccagaagatggcagaccaagcctgggatctccatatggaaaacccccttgctttccagtccctcacaatggcagcagcgaggccaccctgccagcccagatgagcaccctgcatgtgtctccaccccccagcgctgacccagcagaggcctcccgcggagccgggagcagagtcgacctgggctccgaggtgtacaggatgctgcgggagccggccgagcccgtggccgcggagcccaagcagtcaggctccttccgctacttgcagggcatgctagaggccggcgagggcggggattggcccgggcctggcggcccccggaacctcaagcccacggccagcaagctgggcgctccgctgagcggcctgcaggggctgcccgagtgcacgcgctgctgccacggaatcgtgggcaccatcgtcaaggaacgggacaagctctaccatcccgagtgcttcatgtgcagtgactgcggcctgaacctcaagcagcgtggttacttctttctggacgagcggctctactgtgagagccacgccaaggcgcgcgtgaagccgcccgagggctacgacgtggtggcggtgtaccccaatgccaaggtggaactcgtctgagctgggaccctgctcccacccctgcttcttaaggtccctgctcggccggtgtaaatatgtttcaccctgtccctctaataaagctcctctgctcaaaaaaaa

SEQ ID NO: 1095 - DNA, 1392 bp, Homo sapiens
  Genbank Accession No. X95325
gaattccggcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccggaattc

SEQ ID NO: 1096 - DNA, 1973 bp, Homo sapiens
  Genbank Accession No. X96584
gggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttcatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaacgtgttgtatctacagtaatgaaatgtttactaagtggactggtgtcataacttctccattagacacatgactccttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcc

SEQ ID NO: 1097 - DNA, 2046 bp, Homo sapiens
  Genbank Accession No. X99142
ggatcttactgtggtggccgcgccttcagctgcatctcggcctgtgggccccggcccggccgctgctgcatcaccgctgccccctaccgtggcatctcctgctaccgcggcctcaccgggggcttcggcagccacagcgtgtgcggaggctttcgggccggctcctgcggacgcgacttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcagattcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaaatcagacctggaggccaatgtggaggccctgatccaggagatcgacttcctgaggcggctgtatgaggaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaagtgtgaggagatgaaggccacggtgatcaggcacggggagaccctgcgccgcaccaaggaggagatcaacgagctgaaccgcatgatccagaggctgacggctgaggtggagaatgccaagtgccagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggctgtgcgagggcgtcggctcggtgaatgtctgcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaggagaacgcgccgcccgcgccggcctcccaatagccgccgcccgctgcctgcactctaagcgctctccccacgtccgctccgggagccatccccggtcgcaggagtccggggagggccgggaggcgccatggtctctctctgtagcctttcctggtagtcaatttgttgtcccgaggattcatctttttcttcctcctaccttctgttttttttttcatgtatgcattggtcttgcctgagctcttcctcaaagcttggaggaacgggggagggcccgggaatgtccctgtctgcacgacctgggactctgcccatgtgcttttgcctgtggaatggagacgcggaccctggatagtggttctatgactctgcgagggacaggcccacgcgtgtggggagaacatctccttccggggctgccctcaagagcttctgaaaaactaatgactctgctgccttctcctttgtctttgtttcactctgtgtttccaataaactcattgtagcgaatcaaaaaaaaaaaaaaaaaa

SEQ ID NO: 1098 - DNA, 333 bp, Homo sapiens
  Genbank Accession No. X99728
ggtctcatgggcatcgtgtttcctccgcagagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttaccttttttttttttttttttttttggagacag

SEQ ID NO: 1099 - DNA, 1634 bp, Homo sapiens
  Genbank Accession No. Y07595
tcccatcttttcctcgcattttttcaccatctttccctcaatctccaggagccaatgcgagacttttggctccgattaagcgacggcccgagacttggggtgcgcgaggaggatcgacagagtggtgatggagagcaccccttcaaggggactgaaccgagtacacctacaatgcaggaatctgcaggaattcttagggggcctgagccctggggtattggaccgattgtatgggcaccctgccacatgtctggctgtcttcagggagctcccatccttggctaagaactgggtgatgcggatgctctttctggagcagcctttgccacaggctgctgtagctctgtgggtaaagaaggaattcagcaaggctcaggaggaaagtacagggctgctgagcggcctccggatctggcacacccagctgctcccaggcgggctccagggcctcatcctcaaccccattttccgccagaacctccgcattgcccttctgggtggggggaaggcctggtctgatgacacaagtcagctgggaccagacaagcatgcccgggacgttccctcccttgacaagtacgccgaggagcgatgggaggtggtcttgcacttcatggtgggctcccccagtgcagctgtcagccaggacttggctcagctcctcagccaggctgggctcatgaagagtactgaacctggagagccgccctgcattacttccgctggcttccagttcctgttgctggacaccccggctcagctctggtactttatgttgcagtatttgcagacagcccagagccggggcatggacctggtagagattctctccttcctcttccagctcagcttctctactctgggcaaggattactctgtggaaggtatgagtgattctctgttgaacttcctgcaacatctgcgtgagtttgggcttgttttccagaggaagaggaaatctcggcgttactaccccacacgcctggccatcaatctctcatcaggtgtctctggagctgggggcactgtgcatcagccaggtttcattgtcgtggaaaccaattaccgactgtatgcctacacggagtcggagctgcagattgccctcattgccctcttctctgagatgctctatcggttccccaacatggtggtggcgcaggtgacccgggagagtgtgcagcaggcaatcgccagtggcatcacagcccagcagataatccatttcctaaggacaagagcccacccagtgatgctcaaacagacacctgtgctgccccccaccatcaccgaccagatccggctctgggagctggaaagggacagactccggttcactgagggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataagttatgatagct

SEQ ID NO: 1100 - DNA, 1635 bp, Homo sapiens
  Genbank Accession No. Y08374
aaaggaagagaaagggagagagggagagaagagggagagagcagagagacctcaccgagagagctgcaaaaccagcctggaaaaattagagtattacctaacattagtgaaaaataaaggtactttcttgagaagcccttggacccattctgcctcctggagttctgaacttttcactcactgcctattaattaatgttaagcctgcaaagaatggagttgtcctggatatttggccaaaaaaaaaatgtatccacaaacagggacgtaatcaggcagggagcctcgttaagaagttttgttcttgtcctaggagtgatgagagatcactgaaggatttagagaggggctgtatcatcaggcttgggttccaaagcctcactgagagagttggggagctgactgatgtcagatgctcgtgcagccgccccgtagggcctgtatttcctccatggtgcctcactgcagcaccgagcttgcaaaagatcctctctctttatgggaatttcaaaacagaagcaaaatagcaccggggcttaaagcattcttgggaatttccctgtctttccctctaaataatcagcatgtaaattgcaaaaaaaaaaaaaaaaaaaaaagacacgggcccaaaagggagcgctcagtttcaggctctttgctttccttcctcccgaggctctctggcccttacccagcctgaaaacaaaaagtgtgagggggagggtaggaaggtagttcaagcagggcaatgctgagcctgggaagaaaacaacagccttgtttagggcactgtggcttacgtaactaaattgtgcccagtttccacctggccaggggcctggagtgaatgctgaagatgcaaaggtagaggctgccagaaaagccaggaaattgctggcaagaaaggccagtggtggggtgcaggagtgggaggaaggctgggaaatgcggctgagtcacatctccagaagccccccatcatcaccctagtggctcttctgctggcaggcgcctcatgaagacctgacccaaagttttcaaaactctgcggtttctcaaccctcctctggtaatccatagtactcccccgcctccacttgccagcctcgtgattccttcatggacacatagctcagttcccataaaagggctggtttgccgcgtgggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggtatctgggctagccaaggttaatccatcagagttgtgggttttcaggcccagacagcccgcagagccatctgcctgctgggtgagggactaagggagtgggcagagggggaggagaagcagagccaggggagggactgaggctgcaaccaggaggtgggggtgggggagtgggtctcagttgcttgggggagggagcagggcggaagggcaggatgcacttgcaggggtctcatcctggatttctcttcaggctttgtggtcctggtgctgctccagtgctgtgagtaatccctccacctccacttttaagtcca

SEQ ID NO: 1101 - DNA, 4148 bp, Homo sapiens
  Genbank Accession No. Y08614
aggaaggaaggagcagttggttcaatctctggtaatctatgccagcaattatgacaatgttagcagaccatgcagctcgtcagctgcttgatttcagccaaaaactggatatcaacttattagataatgtggtgaattgcttataccatggagaaggagcccagcaaagaatggctcaagaagtactgacacatttaaaggagcatcctgatgcttggacaagagtcgacacaattttggaattttctcagaatatgaatacgaaatactatggactacaaattttggaaaatgtgataaaaacaaggtggaagattcttccaaggaaccagtgcgaaggaataaaaaaatacgttgttggcctcattatcaagacgtcatctgacccaacttgtgtagagaaagaaaaggtgtatatcggaaaattaaatatgatccttgttcagatactgaaacaagaatggcccaaacattggccaacttttatcagtgatattgttggagcaagtaggaccagcgaaagtctctgtcaaaataatatggtgattcttaaactcttgagtgaagaagtatttgatttctctagtggacagataacccaagtcaaatctaagcatttaaaagacagcatgtgcaatgaattctcacagatatttcaactgtgtcagtttgtaatggaaaattctcaaaatgctccacttgtacatgcaaccttggaaacattgctcagatttctgaactggattcccctgggatatatttttgagaccaaattaatcagcacattgatttataagttcctgaatgttccaatgtttcgaaatgtctctctgaagtgcctcactgagattgctggtgtgagtgtaagccaatatgaagaacaatttgtaacactatttactctgacaatgatgcaactaaagcagatgcttcctttaaataccaatattcgacttgcgtactcaaatggaaaagatgatgaacagaacttcattcaaaatctcagtttgtttctctgcacctttcttaaggaacatgatcaacttatagaaaaaagattaaatctcagggaaactcttatggaggcccttcattatatgttgttggtatctgaagtagaagaaactgaaatctttaaaatttgtcttgaatactggaatcatttggctgctgaactctatagagagagtccattctctacatctgcctctccgttgctttctggaagtcaacattttgatgttcctcccaggagacagctatatttgcccatgttattcaaggtccgtttattaatggttagtcgaatggctaaaccagaggaagtattggttgtagagaatgatcaaggagaagttgtgagagaattcatgaaggatacagattccataaatttgtataagaatatgagggaaacattggtttatcttactcatctggattatgtagatacagaaagaataatgacagagaagcttcacaatcaagtgaatggtacagagtggtcatggaaaaatttgaatacattgtgttgggcaataggctccattagtggagcaatgcatgaagaggacgaaaaacgatttcttgttactgttataaaggatctattaggattatgtgaacagaaaagaggcaaagataataaagctattattgcatcaaatatcatgtacatagtaggtcaatacccacgttttttgagagctcactggaaatttctgaagactgtagttaacaagctgttcgaattcatgcatgagacccatgatggagtccaggatatggcttgtgatactttcattaaaatagcccaaaaatgccgcaggcatttcgttcaggttcaggttggagaagtgatgccatttattgatgaaattttgaacaacattaacactattatttgtgatcttcagcctcaacaggttcatacgttttatgaagctgtggggtacatgattggtgcacaaacagatcaaacagtacaagagcacttgatagaaaagtacatgttactccctaatcaagtgtgggatagtataatccagcaggcaaccaaaaatgtggatatactgaaagatcctgaaacagtcaagcagcttggtagcattttgaaaacaaatgtgagagcctgcaaagctgttggacacccctttgtaattcagcttggaagaatttatttagatatgcttaatgtatacaagtgcctcagtgaaaatatttctgcagctatccaagctaatggtgaaatggttacaaagcaaccattgattagaagtatgcgaactgtaaaaagggaaactttaaagttaatatctggttgggtgagccgatccaatgatccacagatggtcgctgaaaattttgttccccctctgttggatgcagttctcattgattatcagagaaatgtcccagctgctagagaaccagaagtgcttagtactatggccataattgtcaacaagttagggggacatataacagctgaaatacctcaaatatttgatgctgtttttgaatgcacattgaatatgataaataaggactttgaagaatatcctgaacatagaacgaactttttcttactacttcaggctgtcaattctcattgtttcccagcattccttgctattccacctacacagtttaaacttgttttggattccatcatttgggctttcaaacatactatgaggaatgtcgcagatacgggcttacagatactttttacactcttacaaaatgttgcacaagaagaagctgcagctcagagtttttatcaaacttatttttgtgatattctccagcatatcttttctgttgtgacagacacttcacatactgctggtttaacaatgcatgcatcaattcttgcatatatgtttaatttggttgaagaaggaaaaataagtacatcattaaatcctggaaatccagttaacaaccaaatctttcttcaggaatatgtggctaatctccttaagtcggccttccctcacctacaagatgctcaagtaaagctctttgtgacagggcttttcagcttaaatcaagatattcctgctttcaaggaacatttaagagatttcctagttcaaataaaggaatttgcaggtgaagacacttctgatttgtttttggaagagagagaaatagccctacggcaggctgatgaagagaaacataaacgtcaaatgtctgtccctggcatctttaatccacatgagattccagaagaaatgtgtgattaaaatccaaattcatgctgttttttttctctgcaactccgttagcagaggaaaacagcatgtgggtatttgtcgaccaaaatgatgccaatttgtaaattaaaatgtcacctagtggccctttttcttatgtgtttttttgtataagaaattttctgtgaaatatccttccattgtttaagcttttgttttggtcatctttatttagtttgcatgaagttgaaaattaaggcatttttaaaaattttacttcatgcccatttttgtggctgggctggggggaggaggcaaattcaatttgaacatatacttgtaattctaatgcaaaattatacaatttttcctgtaaacaataccaatttttaattagggagcattttccttctagtctatttcagcctagaagaaaagataatgagtaaaacaaattgcgttgtttaaaggattatagtgctgcattgtctgaagttagcacctcttggactgaatcgtttgtctagactacatgtattacaaagtctctttggcaagattgcagcaagatcatgtgcatatcatcccattgtaaagcgacttcaaaaatatgggaacacagttagttatttttacacagttctttttgtttttgtgtgtgtgtgctgtcgcttgtcgacaacagctttttgttttcctcaatgaggagtgttgctcatttgtgagccttcattaactcgaagtgaaatggttaaaaatatttatcctgttagaataggctgcatctttttaacaactcattaaaaaacaaaacaactctggcttttgagatgacttatactaatttacattgtttaccaagctgtagtgctttaagaacactacttaaaaagcaaaataaacttggtttacatttaaaaaaaa

SEQ ID NO: 1102 - DNA, 1463 bp, Homo sapiens
  Genbank Accession No. Y09022
ggtgggcccacacaagcggcgcaccgttaagatggcggctgggctgcggaaacgcggccggtccggttccgcggcccaggcagagggactctgcaagcaatggctgcagcgcgcctggcaagagcggcgcctgctgctgcgggagccgcgctacacgctgctggtggccgcctgcctctgcctggcggaggtgggcatcaccttctgggtcattcacagggtggcatacacagagattgactggaaggcctacatggccgaggtagaaggcgtcatcaatggtacctatgactatacccaactgcagggtgacaccggaccacttgtgtacccagctggtttcgtgtacatctttatggggttgtactatgccaccagccgaggcactgacatccgcatggcccagaacatctttgctgtgctctacctggctaccttgctgcttgtcttcttgatctatcaccagacctgcaaggtacctcccttcgtctttttcttcatgtgctgcgcctcttaccgtgtccactccatctttgtgctgcggctcttcaatgacccagtggccatggtgctgctcttcctcagtatcaacctcctgctggcccagcgctggggctggggctgctgctttttcagcctggcagtctctgtgaagatgaatgtgctgctcttcgcccctgggttactgtttcttctcctcacacagtttggcttccgtggggccctccccaagctgggaatctgtgctggccttcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggacaggggaaagtatcttgtcgctgctgagggatccctccaaaaggaaggttccaccccagccccttacacccaaccagatcgtttctaccctcttcacctccaacttcattggcatctgcttcagccgctccctccactaccagttctacgtctggtatttccacacactgccctacctcctgtgggccatgcctgcacggtggctcacacacctgctcaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggtgggttggactctgcccttccaaataaaccttgctaagtccaaaaaaaaaaaaaaaaaaaaaaaaaa

SEQ ID NO: 1103 - DNA, 1890 bp, Homo sapiens
  Genbank Accession No. Y12711
gacccacgcgtccggggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaa

SEQ ID NO: 1104 - DNA, 2038 bp, Homo sapiens
  Genbank Accession No. Z11793
gcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatcatcgaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggttttctgttggataattagcagtttagaatggaggaagaacaacaaagacatgctttccattttttcctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaaggcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaa

SEQ ID NO: 1105 - DNA, 1019 bp, Homo sapiens
  Genbank Accession No. Z35093
cggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 1106 - DNA, 260 bp, Homo sapiens
  Genbank Accession No. Z38266
aaaccacaaatacgtttattcctctaaaaacagtataccatctttccaattttcaaaatgttattatcaattgtctgcagattactctcattaagctgatttttaaaaatctcagacagagcagagcaattcaccagcaccatcatcaagtgagctacaaatctatcttttaccagagcaaggagacacttaagatcaattcaagagaatagctttcagtgttcacagaaggggtactcacattcatttgtcacatattt

SEQ ID NO: 1107 - DNA, 246 bp, Homo sapiens
  Genbank Accession No. Z38551
  unsure (1)..(246): n = a or c or g or t
gaaaatgctttaataagtgttgacaacactgttttgcannntgtaaaggtactatacaaatncttaatacaaaaagaataaattaaaagcagatttctttttttaattctgcaactttgtctacaacgtacatctttttcattgattacagttgaacagaatccagtaaaatcattttacatgctctacagtcagtttcaggggcancctaatctttttncccccattattaaactagagtccatt

SEQ ID NO: 1108 - DNA, 270 bp, Homo sapiens
  Genbank Accession No. Z38744
  unsure (1)..(270): n = a or c or g or t
aatctgaattaagaataaatttattaggaaattattagtatagttagacagtatccagcaaaaaaggttattttatacctctacttttccaaaacgaggaaacctccccacaaatcccatcaacacacagtcatgctggaaggcattctgtcttactctgttggtttcatgtaaatgtttggggtgactcattccgcctcttctnttctcaagttccaggcttcttgggtagaccaaaactaatacacaatgttagagcacacaagagac

SEQ ID NO: 1109 - DNA, 287 bp, Homo sapiens
  Genbank Accession No. Z38785
atccaggtggttttatttagtaaaattttacaaaagtcagggctgacttcttggctctgcccttcgaagagcacagttttccttagcagataactgggggaagccacgggcccaccagaggctctcgcaggccagtggtgcgacctcctgtccacaaccgtgagggacaaaggcctgtccttgaggctgctgggcaggggcccaggcagtaagtgagggcacctgcgaggctctgaggacacagcacatctgtacaccctcatggtgccctgaccacacagcagcca

SEQ ID NO: 1110 - DNA, 314 bp, Homo sapiens
  Genbank Accession No. Z39874
gtaaataaagttttattggcacagccacgctcgttcattcatatgccattgacatctgctgttgccctacacagcagggtggggacctgctcttcacgggagagctagttgtttaaagcagtggtccccaaccttctgtggtcccccgtgggtgctgaggcacaggctgtatggctgcagtgccaagaatatttcctgcctgacccttcatcggagaagcgtgcccacctgtgctctagattccccatgactgacatttagccactctcctctgtcactctccggggacgtgcacacaccgttggcatgaactg

SEQ ID NO: 1111 - DNA, 323 bp, Homo sapiens
  Genbank Accession No. Z39904
  unsure (1)..(323): n = a or c or g or t
aaggaattataaactaactttaattacttcaacaggaagaatttcaaactatgttgtaattcttattttaaagtttaaatctaattaatatattctgactaacataatcatccaaagataaaagtatttgtgatggcaaatggacagaacaatcatttaggtagcatctaggaatattgctacaattactttacataaatngaaatccacgtctttattagtaatgtnccacacatcttagagtaaaaatttacataagataggcttataaatatacataaatctcaaaattaatcacaaacattaggtacacaattgttata

SEQ ID NO: 1112 - DNA, 326 bp, Homo sapiens
  Genbank Accession No. Z39983
catctttgtaaatacgggcttttattcactgccagctccaggatggaaggagggggtgaatcatgcacagccttggtctaccctccaacactaggcagtgctggacaggggactcagaaagggaagcagagtgggctgttgatgtctggaaagctccctcaccagagtgcccagtgggtcacacagcatcatgggggatgagctggggctggagtcggctgtatctgacaccagaccctccattcaagctcccttgatgacaacgcccacaacagggtctggctgatgctccgttctgccacgactcctgctgggtgatcgtggga

SEQ ID NO: 1113 - DNA, 332 bp, Homo sapiens
  Genbank Accession No. Z40012
acagtctagtgtttattttatgttatggaaggtacacttgaatttcaaaaatttaaaacatatataaaaagtggttagggactaacatttgtatcaacagttgataaatgtctaagattgtttattatacagcagggtacaatggtagtgctaatgccaacagggcaccatggaagttagtctaaaaattatcgctaggctttatacaagcaacaacatatgctgctgctcttagaattttgggaaatgatctgcttctaatactaagcagttctttaacatttttaaatgttatacagtgttacagtatttagtttggcaaatgtttcaaa

SEQ ID NO: 1114 - DNA, 254 bp, Homo sapiens
  Genbank Accession No. Z40186
  unsure (1)..(254): n = a or c or g or t
cagtttttatttatttttatttgatttttttttccttaagaatcatagtaaaccttagcagtagttgggcactgcatgaaaaatgaagtttacatagtttatattatgtacataaactagtgatttacattgatttacacatgattggngcctaatttattaatcagcacgcagcatgtaaatgtgctcaaaagaaatcaaggtttaaaataagttttccataatattcataaacattttcgctggtgtaaatg

SEQ ID NO: 1115 - DNA, 327 bp, Homo sapiens
  Genbank Accession No. Z40332
  unsure (1)..(327): n = a or c or g or t
atcttcttcactggacttataaatagccttagttataacaccttcaagttcttttaccagcttcgtaaactcatgatcaaatatcatgtattctggactgggaaagtttggctggggtttctgagatgctctggaatacaactcatgtttgctaataaatcctagtttctctatgaaattctctttgccaatcctcttctcaatcagttgttttagcttctctttcatgtagctctcaagtgagtnatcattgaaataaatcgaaatgcccaacaaaagggcacataagccttggaccaactgctcttcttctccaagattttctgc

SEQ ID NO: 1116 - DNA, 346 bp, Homo sapiens
  Genbank Accession No. Z40556
  unsure (1)..(346): n = a or c or g or t
gagaatacaagaaccttttattttccatccagttgggcagcagggaaaggctaggtgggcccagcctgcccttccttcctccagctggctggatttattatnagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcatg

SEQ ID NO: 1117 - DNA, 292 bp, Homo sapiens
  Genbank Accession No. Z40715
aaaattccttattttatttcaaaaaatgtaggggtggggaagtaacatgataaacattacgatcagctccctatgggttcattctgcctctgcgggggtcgggggcatacagtagctggggggcatgccattgccatggcaacccagatgcttagatgcaggtccctcctggctgcttagagctggggggactaggcgccctccccgaaagcccccattctgagttgttggtgcctgcccttcccctgaatctaagaactgattagtgggttagactgcaacagcagctcag

SEQ ID NO: 1118 - DNA, 270 bp, Homo sapiens
  Genbank Accession No. Z40898
ggtcgttatgctgcatttattatgagaatcaacagtcaacagttaatgattgactaactcttgttgttcactctggacattaacgaaaaagactggaatagggctacagcgctgcttttatgctacacgggttatgcttggactctgactcccagcagcaggtagattcaggaattcatggcagtgacattcaccatcatgggaaacaccttcccttttcttcaggattctctgtagtggaagagagcacccagtgttgggctgaaaaca

SEQ ID NO: 1119 - DNA, 333 bp, Homo sapiens
  Genbank Accession No. Z41642
  unsure (1)..(333): n = a or c or g or t
cagatatccaatttttaattaattaaaactttacaatgtattacataatccatggaaggagagaaaggggatgaaactgaaggaaccaggactctggaggatgcaggatgctgtttctctggatgagatgtactctgccactgtnctctctgggcactttcagatgatggggtctgagatgtgtcctcaggctgcatcagctgtcttcagtctccagaacagaaagagcctgacccaggggcatcttggtggccaccagaaccaggtttctgggagagagttcaggactgaagatgggcaggagctcagcatggaaacctgggagaaagggcc

SEQ ID NO: 1120 - DNA, 324 bp, Homo sapiens
  Genbank Accession No. Z41763
caacacgcctgaagtgatgtttaattaatgatgataatggacggggatttgagaaatcttttcattttcgcttgctaataataattttagtcagagttacaagtagggttcttgaaaaaaaaacatatctgacgtataaagacaatggattcagggatacttgatcaaattgtttctgatgaatgaggacccacactctctgctgtcacaaacaggaggtggggcccaagaaacagtggtgaaagatgtttcaggttgatctgcaatggattattcacagcaacaatgaggatgatacagtttcagctttttcctccagcaagg

SEQ ID NO: 1121 - DNA, 1569 bp, Homo sapiens
  Genbank Accession No. Z48501
atgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatcgcagctatcccacagactcagaaccgtgctgcatactatcctcctagccaaattgctcaactaagaccaagtcctcgctggactgctcagggtgccagacctcatcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaa

SEQ ID NO: 1122 - DNA, 4553 bp, Homo sapiens
  Genbank Accession No. Z69881
ggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggcgctggactacaacgaggccaagggtgtgtacgagaaggtgggagaggccacggagacagctctgacttgcctggtggagaagatgaatgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctaccggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagatggcctacctgccacggctctgggcttcaacccgccagacctggacatcatagagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggccggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 1123 - DNA, 5086 bp, Homo sapiens
  Genbank Accession No. Z74616
  unsure (1)..(5086): n = a or c or g or t
agcaccacggcagcaggaggtttcggnctaagttggaggtactggnccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcatggtgctgtaggtgcccctggtcctgctggagccacaggtgaccggggcgaagctggggctgctggtcctgctggtcctgctggtcctcggggaagccctggtgaacgtggcgaggtcggtcctgctggccccaacggatttgctggtccggctggtgctgctggtcaaccgggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctacctggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacggttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccatgaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 1124 - DNA, 638 bp, Homo sapiens
  Genbank Accession No. M35590
gcttctgaagcttctgggccctgcagtcccagctctgtgcaaacctaaccccgagcaacaccatgaagctctgcgtgtctgccctctctctcctcttgctcgtggctgccttctgtgctccagggttctcagcaccaatgggctctgaccctcccacttcctgctgtttctcttacacctcccggcagcttcacagaagctttgtgatggattactatgagaccagcagtctttgctccaagccagctgtggtattcctgaccaaaagaggcagacagatctgtgctaaccccagtgagccctgggtcactgagtacatgagtgacttggagttgaactgagcagctccagcggcagggcaggaggagccacttcaggagaggcctcctcagccctgatgcttctcactgagaagcgtccttgctcctcacgttcagatttcctgcccctcttcttaatttaaatctctgtgtagactttgttttgtttttttgggggagtattatttctattatttatgttttagttataggacgcgtgtctcccatggagatggtccaccattgctgtttctctgctattgtggatatgactgtgaaattgatttcatgcattttcataataaatctttctttaag

We claim:

1. A computer system comprising:
   (a) a processor; and
   (b) a computer readable storage medium storing executable instructions that, when executed by the processor, cause the processor to perform a plurality of steps, wherein the steps include:
   (i) comparing an expression profile of a test sample from a subject to a reference expression profile, wherein the expression profile of the test sample comprises statistical measures of differential expression of two or more nucleic acid sequences selected from SEQ ID NO: 1 to 1124 in the test sample as compared to a control sample from a normal individual and the reference expression profile comprises statistical measures of differential expression of said two or more nucleic acid sequences in a individual diagnosed with benign prostatic hyperplasia (BPH) as compared to a normal individual; and
   (ii) identifying the presence or absence of BPH in the subject, wherein differential expression of said two or more nucleic acid sequences in the test sample is indicative of BPH.

2. The computer system of claim 1, wherein the expression profile of the test sample comprises statistical measures of differential expression of 10 or more nucleic acid sequences selected from SEQ ID NO: 1 to 1124.

3. The computer system of claim 1, wherein the expression profile of the test sample comprises statistical measures of differential expression of each of SEQ ID NO: 1 to 1124.

4. The computer system of claim 1, further comprising records including information from an external database, which information correlates said nucleic acid sequences to records in said external database.

5. The computer system of claim 1, wherein the reference gene expression profile is part of a database.

6. The computer system of claim 5, wherein the database further comprises nucleotide sequence information for said nucleic acid sequences.

7. The computer system of claim 6, wherein said database further comprises descriptive information about said nucleic acid sequences.

8. The computer system of claim 5, wherein said database further comprises descriptive information from the subject.

9. The computer system of claim 8, wherein said descriptive information is selected from the group consisting of subject age, disease status and treatment status.

10. The computer system of claim 9, wherein said disease status information comprises prostate specific antigen (PSA) serum level values.

11. The computer system of claim 9, wherein said disease status information comprises information related to disease progression.

12. A computer system comprising:
   (a) a processor; and
   (b) a computer readable storage medium storing executable instructions that, when executed by the processor, cause the processor to perform a plurality of steps, wherein the steps include:
   (i) comparing an expression profile of a test sample from a subject to a reference expression profile, wherein the expression profile of the test sample comprises statistical measures of differential expression of five or more nucleic acid sequences selected from SEQ ID NO: 1 to 1124 in the test sample as compared to a control sample from a normal individual and the reference expression profile comprises statistical measures of differential expression of said five or more nucleic acid sequences in a individual diagnosed with benign prostatic hyperplasia (BPH) as compared to a normal individual; and
   (ii) identifying the presence or absence of BPH in the subject, wherein differential expression of said five or more nucleic acid sequences in the test sample is indicative of BPH.

* * * * *